US008324350B2

(12) United States Patent
Hsieh et al.

(10) Patent No.: US 8,324,350 B2
(45) Date of Patent: Dec. 4, 2012

(54) DUAL-SPECIFIC IL-1α/IL-1β ANTIBODIES

(75) Inventors: Chung-ming Hsieh, Newton, MA (US);
Bradford L. McRae, Northborough, MA (US); Yuliya Kutskova, Northborough, MA (US); John E. Memmott, Framingham, MA (US); Michael Roguska, Ashland, MA (US); Ian Tomlinson, Cambridge (GB); Carrie Enever, Cambridge (GB); Steven Grant, Ely (GB); Mihriban Tuna, Cambridge (GB)

(73) Assignee: Abbott Laboratories, Abbott Park, IL (US)

( * ) Notice: Subject to any disclaimer, the term of this patent is extended or adjusted under 35 U.S.C. 154(b) by 837 days.

(21) Appl. No.: 12/006,068

(22) Filed: Dec. 28, 2007

(65) Prior Publication Data

US 2009/0291081 A1 Nov. 26, 2009

Related U.S. Application Data

(60) Provisional application No. 60/878,165, filed on Dec. 29, 2006.

(51) Int. Cl.
*C07K 16/00* (2006.01)
(52) U.S. Cl. .................. 530/387.1; 424/130.1
(58) Field of Classification Search .......... None
See application file for complete search history.

(56) References Cited

U.S. PATENT DOCUMENTS

| 5,168,062 | A | 12/1992 | Stinski |
| 5,179,017 | A | 1/1993 | Axel et al. |
| 5,580,717 | A | 12/1996 | Dower et al. |
| 5,622,701 | A | 4/1997 | Berg |
| 5,627,052 | A | 5/1997 | Schrader et al. |
| 5,756,095 | A | 5/1998 | Juntila |
| 5,885,793 | A | 3/1999 | Griffiths et al. |
| 5,939,598 | A | 8/1999 | Kucherlapati et al. |
| 5,969,108 | A | 10/1999 | McCafferty et al. |
| 6,036,978 | A | 3/2000 | Gombotz et al. |
| 7,270,816 | B2 | 9/2007 | Timans et al. |
| 7,491,516 | B2 * | 2/2009 | Collinson et al. .......... 435/70.21 |
| 2003/0040083 | A1 | 2/2003 | Collinson et al. |
| 2006/0106203 | A1 | 5/2006 | Winter et al. |
| 2009/0232736 | A1 | 9/2009 | Collinson et al. |
| 2009/0291081 | A1 | 11/2009 | Hsieh et al. |

FOREIGN PATENT DOCUMENTS

| EP | 218531 A | 4/1987 |
| EP | 436597 | 3/1990 |
| EP | 589877 | 1/1992 |
| WO | WO 92/01047 | 1/1992 |
| WO | WO 92/02551 | 2/1992 |
| WO | WO 92/09690 | 6/1992 |
| WO | WO 92/20791 | 11/1992 |
| WO | WO 97/08320 | 3/1997 |
| WO | WO 97/29131 | 8/1997 |
| WO | WO 98/20159 | 5/1998 |
| WO | WO 98/31700 | 7/1998 |
| WO | WO 98/47343 | 10/1998 |
| WO | WO 98/49286 | 11/1998 |
| WO | WO 99/36569 | 7/1999 |
| WO | WO 99/45962 | 9/1999 |
| WO | WO 00/56772 | 9/2000 |
| WO | WO 02/02773 | 1/2002 |
| WO | WO03/002609 | 1/2003 |
| WO | WO 2007/063308 | 6/2007 |
| WO | WO2008/082651 | 7/2008 |

OTHER PUBLICATIONS

Rudikoff et al. Proc Natl Acad Sci USA 1982 vol. 79 p. 1979.*
MacCallum et al. J. Mol. Biol. (1996) 262, 732-745.*
Pascalis et al. The Journal of Immunology (2002) 169, 3076-3084.*
Casset et al. BBRC 2003, 307:198-205.*
Vajdos et al. J. Mol. Biol. (2002) 320, 415-428.*
Chen et al. J. Mol. Bio. (1999) 293, 865-881.*
Wu et al. J. Mol. Biol. (1999) 294, 151-162.*
Padlan et al. PNAS 1989, 86:5938-5942.*
Lamminmaki et al. JBC 2001, 276:36687-36694.*
Nielsen et al. (Cancer Research, vol. 60, p. 6434-6440, Nov. 2000).*
Geiger, T. et al: "Neutralization of 15 Interleukin-1 Beta Activity In Vivo with a Monoclonal Antibody Alleviates Collagen-Induced Arthritis in DBA/1 Mice and Prevents the Associated Acute-Phase Response" *Clinical and Experimental Rheumatology*, vol. 11, No. 5, Sep. 1, 1993. pp. 515-522.
Van De Loo, F.A., "Modulation of Cartilage Destruction in Murine Arthritis with Anti-IL-1 Antibodies." *Agents and Actions Supplements;Inflammatory Disease Therapy: Preclinical and Clinical Developments*. p. 169. 1993 and Sixth International Meeting; White Haven, Pennsylvania, USA; Sep. 20-24, 1992. p. 169, Lines 1-20.
Van De Loo, F.A., et al.: "Modulation of Cartilage Destruction in Murine Arthritis with Anti-IL-1 Antibodies."*Agents and Actions*, vol. 39 Spec. No.,pp. C211-C214, 1993.
Withoff et al. "Bi-specific antibody therapy for the treatment of cancer". *Current Opinions in Molecular Therapy*, vol. 3(1). pp. 53-62, 2001.
Harlow et al., Eds. *Antibodies, a Laboratory Manual* Cold Spring Harbor Lab. pp. 240-241. , 1988.
U.S. Appl. No. 60/126,603, filed Mar. 25, 1999, Salfeld et al.
Dinant, HJ et al., "New Therapeutic Targets for Rheumatoid Arthritis," Pharm World Sci, vol. 21, No. 2, 1999, pp. 49-59.
Harlow et al., Eds. Antibodies, A Laboratory Manual, 1988 Cold Spring Harbor Lab. pp. 25,42, 72, and 76.
A_Geneseq_21 Database, Jan. 6, 2006, Result 4, AC No. AAP71394.
Kock et al., J. Exp. Med., 1986, vol. 163, No. 2, pp. 463-468.
Miwa et al., Nature Medicine, 1998, vol. 4, No. 11, pp. 1287-1292.
Luger TA, "Monoclonal Anti-IL 1 is directed against a common site of human IL 1a dn IL B."Immunobiol., vol. 172, p. 346-356 (1986).

(Continued)

*Primary Examiner* — Laura B Goddard
*Assistant Examiner* — Meera Natarajan
(74) *Attorney, Agent, or Firm* — McCarter & English, LLP; Cristin H. Cowles; Jin Wang, Esq.

(57) ABSTRACT

The invention provides an isolated, dual-specific antibody, or an antigen-binding portion thereof, which is specific for human IL-1α and human IL-1β. The dual specific antibodies of the invention also neutralize both human IL-1α and human IL-1β. The invention also provides domain antibodies (dAbs) specific for human IL-1α and human IL-1β.

92 Claims, 25 Drawing Sheets

OTHER PUBLICATIONS

Karlin and Alschul, "Applications and statistics for multiple high-scoring segments in molecular sequences", Proc. Natl. Acad. Sci USA, 90:5873-77 (1993).

Altschul et al., "Gapped BLAST and PSI-BLAST: a new generation of protein database search programs", Nucleic Acids Research, 25(17): 3389-3402 (1997).

Altschul et al. "Basic local alignment search tool", J. Mol. Biol. 215:403-10 (1990).

Myers and Miller, "Optimal alignments in linear space", Comput. Appl. Biosci., 4:11-17 (1988).

Jameson and Wolf, "The antigenic index: a novel algorithm for predicting antigenic determinants", CABIOS, 4(1), 181-186 (1998).

Kohler and Milstein, "Continuous cultures of fused cells secreting antibody of predefined specificity", Nature 256:495-497 (1975).

G. Galfre et al. "Antibodies to major histocompatibility antigens produces by hybrid cell lines", Nature 266:550-52 (1977).

Roes, J. et al. "Mouse anti-mouse IgD monoclonal antibodies generated in IgD deficient mice." J. Immunol. Methods; 183:231-237 (1995).

Lunn, M.P. et al. "High-affinity anti-ganglioside IgG antibodies raised in complex ganglioside knockout mice; reexamination of GD1a Immunolocalization" J. Neurochem. 75:404-412 (2000).

MacQuitty, J.J. and Kay, R.M. "GenPhrm's knockout mice" Science 257:1188 (1992).

Lonberg, N. et al. "Antigen-specific human antibodies from mice comprising four distinct genetic modifications." Nature; 368:856-859 (1994).

Fishwild, D.M. et al. "High-avidity human IgG kappa monoclonal antibodies from a novel strain of minilocus transgenic mice" Nature Biotechnology; 14:845-851 (1996).

Mendez, M.J. et al. "Functional transplant of megabase human immunoglobulin loci recapitulates human antibody response in mice." Nature Genetics; 15:146-156, Feb. 1997.

Leader, K.A. et al. "Antibdy responses to the blood group antigen D in SCID mice reconstituted with human blood mononuclear cells." Immunology; 76:229-234 (1992).

Bombil, F. et al. "A promising model of primary human immunization in human -SCID mouse." Immunobiol. 195:360-375 (1996).

Heard, C. et al. "Two neutralizing human anti-RSV antibodies: cloning, expression, and characterization." Molec. Med. 5:35-45 (1999).

Eren, R. et al. "Human monoclonal antibodies specific to hepatitis B virus generated in a human/mouse radiation chimera: the Trimera system", Immunology, 93:154-161 (1998).

Reisner, Y and Dagan, S. "The Trimera mouse: generating human monoclonal antibodies and an animal model for human diseases," Trends Biotechnol. 16:242-246 (1998).

Clackson et al. "Making antibody fragment using phage display libraries" Nature; 352:624-628 (1991).

Gram et al. "In vitro selection and affinity maturation of antibodies from a naïve combinatorial immunoglobulin library" PNAS; 89:3576-3580 (1992).

Barbas et al. "Assembly of combinatorial antibody libraries on phage surfaces: The gene III site" PNAS; 88:7978-7982 (1991).

McCafferty et al. "Phage antibodies: filamentous phage displaying antibody variable domains", Nature 348:552-554 (1990).

Knappik et al. "Fully synthetic human combinatorial antibody libraries (HuCAL) based on modular consensus frameworks and CDRs randomized with trinucleotides", J. Mol. Biol. 296:57-86 (2000).

Bird et al. "Single-chain antigen-binding proteins", Science 242:423-426 (1988).

Huston et al. "Protein engineering of antibody binding sites: recovery of specific activity in an anti-digoxin single chain Fv analogue produced in *Eschericia coli*", Proc. Natl. Acad. Sci. USA 85:5879-5883 (1988).

Boss, M.A. and Wood, C.R. "Genetically engineered antibodies", Immunology Today, 6:12-13, 1985.

Kaufman, R.J. and P.A. Sharp "Amplification and expression of sequences contransfected with a modular dihydrofolate reductase complementary DNA gene", Mol. Biol. 159:601-621 (1982).

Roberts, R.W. and Szostak, J.W. "RNA-peptides fusions for the in vitro selection of peptides and proteins", Proc. Natl. Acad. Sci. USA 94:12297-12302 (1997).

Babcock, J.S. et al. "A novel strategy for generating monoclonal antibodies from a single, isolated lymphocytes producing antibodies of defined specificities", Proc. Natl. Acad. Sci. USA; 93: 7843-7848 (1996).

Holliger, P. et al. "Diabodies: small bivalent and bispecific antibody fragments", Proc. Natl. Acad. Sci. USA 90: 6444-6448 (1993).

Poljak, R.J. et al. "Production and structure of diabodies", Structure; 2:1121-1123 (1994).

Albert, A.E. et al. "Time-dependent induction of protective anti-influenza immune responses in human peripheral blood lymphocytes/SCID mice", J. Immunol.; 159(3):1393-1402 (1997).

Arai, K. et al. "An ELISA to determine the biodistribution of human monoclonal antibody in tumor-xenografted SCID mice", J Immunol Method.; 217(1-2):79-85 (1998).

Bocher, W.O. et al. "Antigen specific B and T cells in human/mouse radiation chimera following immunization vivo", Immunology; 96(4):634-41 (1999).

Chamat, S. et al. "Human monoclonal antibodies isolated from spontaneous Epstein-Barr virus transformed tumors of Hu-SPL-SCID mice and specific for fusion protein display broad neutralizing activitiy toward respiratory syntial virus", J Infect Dis.; 180(2): 268-77 (1999).

Gallo, M.L. et al. "The human immunoglobulin loci introduced into mice: V(D) and J gene segments usage similar to that of adult humans." Eur J Immunol. 30:534-40 (2000).

Green, L.L. "Antibody engineering via genetic engineering of the mouse:XenoMouse strains are a vehicle for the facile generation of therapeutic human monoclonal antibodies", J Immunol Methods; 231(1):11-23(13) (1999).

Harding, F.A. et al. "Class switching in human immunoglobulin transgenic mice", Ann. NY Acad. Sci.; 29:764:536-546 (1995).

Herz, U. et al. "The humanized (Hu-PBMC) SCID mouse as an in vivo model for human IgE production and allergic inflammation of the skin", Int Arch Allergy Immunol.; 113(1-3):150-2 (1997).

Hutchins, W.A. et al. "Human immune response to a peptide mimic of Neisseria meningitides serogroup C in hu-PBMC-SCID mice", Hybridoma; 18(2):121-9 (1999).

Ilan, E. et al. "The hepatitis B virus-trimera mouse: a model for human HBV infection and evaluation of anti-HBV therapeutic agents", Hepatology; 29(2):535-62 (1999).

Lonberg, N. "Human antibodies from transgenic mice", Int Rev Immunol. 13(1): 65-93 (1995).

Murphy, W.J. et al. "CD40 stimulation promotes human secondary immunoglobulin responses in HuPBL-SCID chimeras", Clin Immunol. 90(1):22-7 (1999).

Nguyen, H. et al. "Production of human monoclonal antibodies in SCID mouse", Microbiol Immunol. 41(12): 901-7 (1997).

Smithson, S.L. et al. "Molecular analysis of the heavy chain of antibodies that recognize the capsular polysaccharide of Neisseria meningitides in hu-PBMC reconstituted SCID mice and in the immunized human donor", Mol. Immunol.; 36:113-24 (1999).

Taylor, L.D. et al. "A transgenic mouse that expresses a diversity of human sequence heavy and light chain immunoglobulins", Nucleic Acids Res. 20(23):6287-95 (1992).

Yang, X.D. et al. "Fully human anti-interleukin-8 monoclonal antibodies: potential therapeutics for the treatment of inflammatory disease states", J. Leukoc. Biol. 66(3):401-10 (1999).

Yoshinari, K. et al. "Differential effects of immunosuppressants and antibiotics on human monoclonal antibody production in SCID mouse ascites by five heterohybridomas", Hybridoma; 17(1):41-5 (1998).

Green, L.L. et al. "Regulation of B cell development by variable gene complexity in mice reconstituted with human immunolglobulin yeast artificial chromosomes", J Exp Med.; 188(3)483-95 (1998).

Murphy, W.J. et al. "The huPBL-SCID mouse as a means to examine human immune function in vivo", Semin Immunol.; 8:233-41 (1996).

\* cited by examiner

| | CDR1 | CDR2 | CDR3 |
|---|---|---|---|
| ABT-2108 | EYTMM | RIGQDGKNTYYADSVKG | YTGRVGVHHLFDY |
| -502 | MESMM | | |
| -503 | EEKWM | | |
| -504 | DEGMM | | |
| -505 | EYGLI | | |
| -509 | | RITYSGKNTYYADSVKG | |
| -511 | | RIGQDGKNTVIRDSVKG | |
| -513 | | RIGQDGKNTVDRDSVKG | |
| -514 | | RIGQDGKNTWTRDSVKG | |
| -518 | | RIGQDGKNTYYRMDVKG | |
| -521 | | | YTGRILGHHLFDY |
| -523 | | | YDGWVGVHHLFDY |
| -524 | | | YTGRVFNHHLFDY |
| -527 | | | YTGRVFKHHLFDY |
| -531 | | | YTGRIFSHHLFDY |

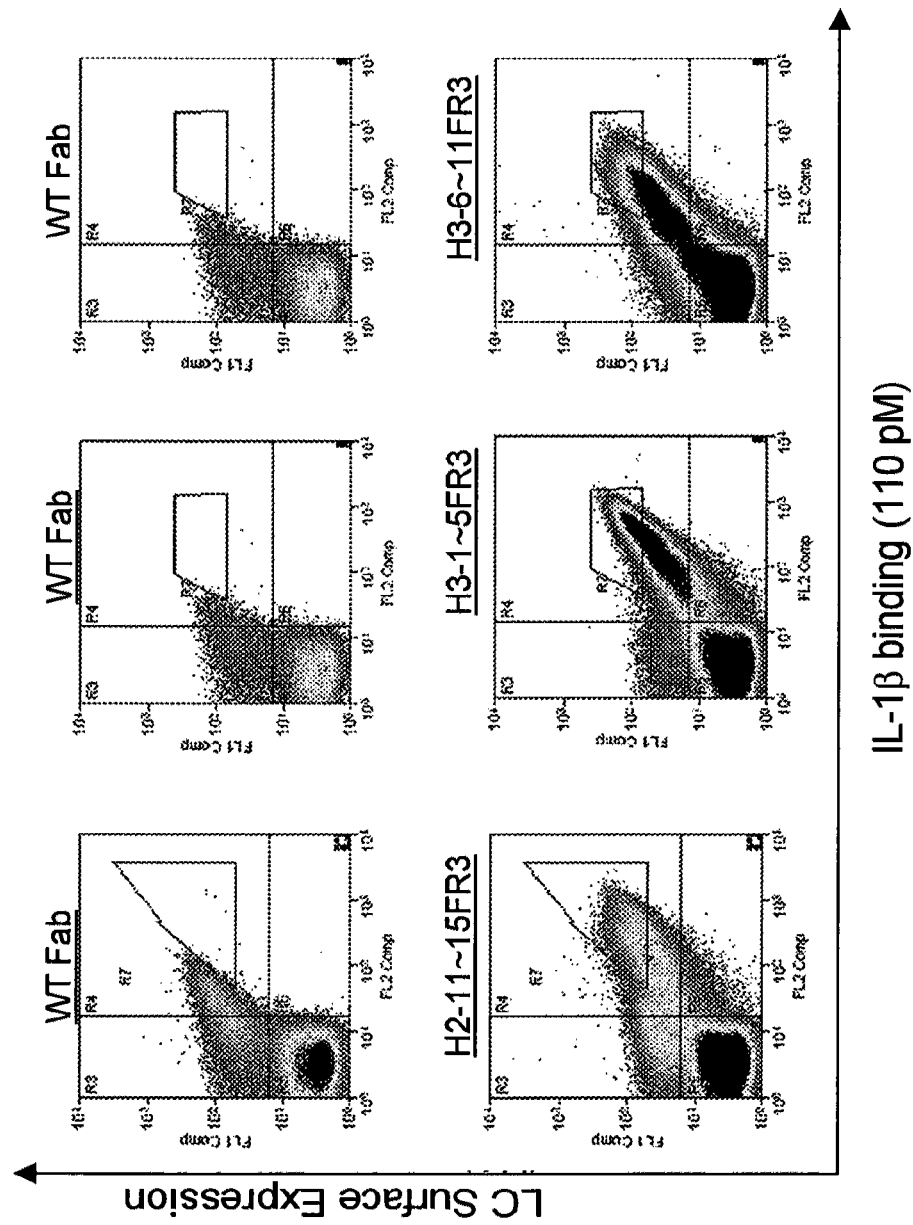

```
                   10         20         30         40         50         60         70         80         90        100
                   ....|....|....|....|....|....|....|....|....|....|....|....|....|....|....|....|....|....|....|....|
VK dummy      DIQMTQSPSSLSASVGDRVTITCRASQSISSYLNWYQQKPGKAPKLLIYAASSLQSGVPSRFSGSGSGTDFTLTISSLQPEDFATYYCQQSYSTPNTFGQGTKVEIKR
ABT1-141      .....................................W.OKQ.A..............SS.Y..................................HLRV.F.......
ABT1-141-25   .....................................W.OKQ.A..............SS.Y..................................HLRV.M.......
ABT1-141-47   ...................................N.W.OKQ.A..............SS.H.........................Q........HLRV.M.......
ABT1-141-76   ...................................N.W.OKQ.A..............SS.H..................................HLRV.M.......
```

D.

```
                   10         20         30         40         50         60         70         80         90        100        110        120
                   ....|....|....|....|....|....|....|....|....|....|....|....|....|....|....|....|....|....|....|....|....|....|
VH dummy      EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSYGA------FDYWGQGTLVTVSS
ABT2-65       ...............................ED.Q.G..............S..AM.NR.....................D..............NLVRTQSRMWM.........
ABT2-65-17    ..............V................ED.Q.G..............S..AM.NR.....................D..............QNLVRLGRSRWM.........
ABT2-65-166   ...............................ED.Q.G..............S..AM..R....................................QNLVRLGRSRWM.........
```

DUAL-SPECIFIC IL-1α/IL-1β ANTIBODIES

RELATED APPLICATIONS

This application claims priority to U.S. Provisional Appln. No. 60/878,165, filed on Dec. 29, 2006, which is incorporated in its entirety herein.

REFERENCE TO JOINT RESEARCH AGREEMENT

Contents of this application are under a joint research agreement entered into by and between Domantis Limited and Abbott Laboratories on Oct. 25, 2002, and directed to recombinantly engineered antibodies to IL-1.

SEQUENCE LISTING

The instant application contains a Sequence Listing which has been submitted in ASCII format via EFS-Web and is hereby incorporated by reference in its entirety. Said ASCII copy, created on May 26, 2011, is named 11781333.txt and is 847,313 bytes in size.

BACKGROUND OF THE INVENTION

Cytokines, such as interleukin-1 (IL-1) and tumor necrosis factor (TNF), are molecules produced by a variety of cells, such as monocytes and macrophages, which have been identified as mediators of inflammatory processes. Interleukin-1 is a cytokine with a wide range of biological and physiological effects, including fever, prostaglandin synthesis (in e.g., fibroblasts, muscle and endothelial cells), T-lymphocyte activation, and interleukin 2 production.

cDNAs coding for two distinct forms of IL-1 have been isolated and expressed; these cDNAs represent two different gene products, termed IL-1β (Auron et al. (1984) *Proc. Natl. Acad. Sci. USA* 81:7909) and IL-1α (Lomedico et al. (1984) Nature 312:458). IL-1β is the predominant form produced by human monocytes both at the mRNA and protein level. The two forms of human IL-1 share only 26% amino acid homology. Despite their distinct polypeptide sequences, the two forms of IL-1 have structural similarities (Auron et al. (1985) *J. Mol. Cell Immunol.* 2:169), in that the amino acid homology is confined to discrete regions of the IL-1 molecule.

The two forms of IL-1 possess similar biological properties, including induction of fever, slow wave sleep, and neutrophilia, T- and B-lymphocyte activation, fibroblast proliferation, cytotoxicity for certain cells, induction of collagenases, synthesis of hepatic acute phase proteins, and increased production of colony stimulating factors and collagen. As such, both forms of IL-1 have been implicated in the pathophysiology of a variety of human diseases and disorders, including autoimmune and inflammatory diseases, e.g., multiple sclerosis (Brosnan et al. (1995). Neurology 45(6 suppl 6):

Antibodies capable of binding of IL-1α and IL-1β have been described in the art (see US Publication No. 20030040083 and PCT publication WO 07/063,308). However, there exists a need for improved therapeutics to IL-1α and IL-1β.

SUMMARY OF THE INVENTION

High levels of IL-1α and IL-1β are major concerns in the management and treatment of inflammatory disease. The invention provides a therapeutic means with which to inhibit both IL-1α and IL-1β by providing compositions and methods for treating disease associated with increased levels of IL-1α/IL-1β, particularly inflammatory disorders.

The invention includes an isolated, dual-specific antibody, or an antigen-binding portion thereof, which dissociates from human IL-1α with a $K_D$ of $3\times10^{-7}$ M or less; dissociates from human IL-1β with a $K_D$ of $5\times10^{-5}$ M or less; and does not bind mouse IL-1α or mouse IL-1β.

In one embodiment, the antibody, or antigen-binding portion, neutralizes human IL-1α in a standard in vitro assay with an $ND_{50}$ of 900 nM or less.

In one embodiment, the antibody, or antigen-binding portion, neutralizes human IL-1β in a standard in vitro assay with an $ND_{50}$ of 800 nM or less.

In one embodiment, the antibody, or antigen-binding portion, neutralizes human IL-1α in a standard in vitro assay with an $ND_{50}$ of 900 nM or less, and neutralizes human IL-1β in a standard in vitro assay with an $ND_{50}$ of 800 nM or less.

In one embodiment, the antibody, or antigen-binding portion, neutralizes human IL-1α in a standard in vitro MRC5 assay with an $ND_{50}$ of 900 nM or less, and/or neutralizes human IL-1β in a standard MRC5 in vitro assay with an $ND_{50}$ of 800 nM or less.

In one embodiment, the antibody, or antigen-binding portion, dissociates from IL-1α with a $K_D$ of $1\times10^{-8}$ M or less; dissociates from IL-1α with a $K_D$ of $1\times10^{-9}$ M or less; dissociates from IL-1α with a $K_D$ of 40-86 nM or less; dissociates from IL-1α with a $K_D$ of 20-42 nM or less; dissociates from IL-1α with a $K_D$ of 32-42 nM or less; dissociates from IL-1α with a $K_D$ of 7-12 nM or less; dissociates from IL-1α with a $K_D$ of $3.0\times10^{-7}$ M or less; dissociates from IL-1α with a $K_D$ of $1.1\times10^{-7}$ M or less; dissociates from IL-1α with a $K_D$ of $6.1\times10^{-8}$ M or less; dissociates from IL-1α with a $K_D$ of $6\times10^{-8}$ M or less; dissociates from IL-1α with a $K_D$ of $4.2\times10^{-8}$ M or less; dissociates from IL-1α with a $K_D$ of $1.3\times10^{-8}$ M or less; or dissociates from IL-1α with a $K_D$ of $1.1\times10^{-9}$ M or less.

In one embodiment, the antibody, or antigen-binding portion thereof, dissociates from IL-1β with a $K_D$ of $5.4\times10^{-5}$ M or less; dissociates from IL-1β with a $K_D$ of $2.8\times10^{-6}$ M or less; dissociates from IL-1β with a $K_D$ of $1.3\times10^{-6}$ M or less; dissociates from IL-1β with a $K_D$ of $9.3\times10^{-7}$ M or less; dissociates from IL-1β with a $K_D$ of $2\times10^{-7}$ M or less; dissociates from IL-1β with a $K_D$ of $1.1\times10^{-7}$ M or less; or dissociates from IL-1β with a $K_D$ of $2.8\times10^{-8}$ M or less.

In one embodiment, the antibody, or antigen-binding portion thereof, neutralizes IL-1α in a standard in vitro assay with an $ND_{50}$ of 10 nM or less. In one embodiment, the antibody, or antigen-binding portion thereof, neutralizes IL-1β in a standard in vitro assay with an $ND_{50}$ of 200 nM or less. In one embodiment, the antibody, or antigen-binding portion thereof, neutralizes IL-1α in a standard MRC5 in vitro assay with an $ND_{50}$ of 10 nM or less. In one embodiment, the antibody, or antigen-binding portion thereof, neutralizes IL-1β in a standard in vitro MRC5 assay with an $ND_{50}$ of 200 nM or less.

In another embodiment, the antibody, or antigen-binding portion thereof, of the invention comprises a heavy chain variable region comprising complementary determining regions (CDRs) as set forth in SEQ ID NO: 16 (ABT1-96) and a light chain variable region comprising CDRs as set forth in SEQ ID NO: 36 (ABT242).

In still another embodiment, the antibody, or antigen-binding portion thereof, of the invention comprises a light chain variable region comprising CDRs as set forth in SEQ ID NO: 24 (ABT1-122) and a heavy chain variable region comprising CDRs as set forth in SEQ ID NO: 52 (ABT2-108).

In one embodiment, the antibody, or antigen-binding portion thereof, of the invention comprises a light chain variable region comprising CDRs as set forth in SEQ ID NO: 28 (ABT1-141) and a heavy chain variable region comprising CDRs as set forth in SEQ ID NO: 52 (ABT2-108).

In yet another embodiment, the antibody, or antigen-binding portion thereof, of the invention comprises a heavy chain variable region comprising CDRs as set forth in SEQ ID NO: 16 (ABT1-96) and a heavy chain variable region comprising CDRs as set forth in SEQ ID NO: 32 (ABT2-13).

In still another embodiment, the antibody, or antigen-binding portion thereof, of the invention comprises a heavy chain variable region comprising CDRs as set forth in SEQ ID NO: 4 (ABT1-6-23) and a second heavy chain variable region comprising CDRs as set forth in SEQ ID NO: 40 (ABT2-46).

In another embodiment, the antibody, or antigen-binding portion thereof, of the invention comprises a light chain variable region comprising CDRs as set forth in SEQ ID NO: 28 (ABT1-141) and a heavy chain variable region comprising CDRs as set forth in SEQ ID NO: 44 (ABT2-65).

In another embodiment, the antibody, or antigen-binding portion thereof, of the invention comprises a heavy chain variable region comprising CDRs as set forth in SEQ ID NO: 16 (ABT1-96) and a light chain variable region comprising CDRs as set forth in SEQ ID NO: 40 (ABT2-46).

In another embodiment, the antibody, or antigen-binding portion thereof, of the invention comprises a light chain variable region comprising CDRs as set forth in SEQ ID NO: 12 (ABT1-95) and a heavy chain variable region comprising CDRs as set forth in SEQ ID NO: 32 (ABT2-13).

In yet another embodiment, the antibody, or antigen-binding portion thereof, of the invention comprises a light chain variable region comprising CDRs as set forth in SEQ ID NO: 24 (ABT1-122) and a heavy chain variable region comprising CDRs as set forth in SEQ ID NO: 44 (ABT2-65).

In another embodiment, the antibody, or antigen-binding portion thereof, of the invention comprises a heavy chain variable region comprising CDRs as set forth in SEQ ID NO: 20 (ABT1-98) and a light chain variable region comprising CDRs as set forth in SEQ ID NO: 48 (ABT2-76).

In another embodiment, the antibody, or antigen-binding portion thereof, of the invention comprises a heavy chain variable region comprising CDRs as set forth in SEQ ID NO: 4 (ABT1-6-23) and a second heavy chain variable region comprising CDRs as set forth in SEQ ID NO: 32 (ABT2-13).

The invention also includes an isolated antibody, or an antigen-binding portion thereof, having dual-specificity for human IL-1α and human IL-1β comprising a variable light chain comprising complementary determining regions (CDRs) as set forth in an amino acid sequence selected from the group consisting of SEQ ID NO: 12, SEQ ID NO: 24, and SEQ ID NO: 28, or a variable heavy chain comprising CDRS as set forth in an amino acid sequence selected from the group consisting of SEQ ID NO: 4, SEQ ID NO: 8, SEQ ID NO: 16, and SEQ ID NO: 20.

In one embodiment, the antibody, or antigen-binding portion thereof, dissociates from human IL-1β with a $K_D$ of $5 \times 10^{-5}$ M or less; dissociates from IL-1β with a $K_D$ of $5.4 \times 10^{-5}$ M or less; dissociates from IL-1β with a $K_D$ of $2.8 \times 10^{-6}$ M or less; dissociates from IL-1β with a $K_D$ of $1.3 \times 10^{-6}$ M or less; dissociates from IL-1β with a $K_D$ of $9.3 \times 10^{-7}$ M or less; dissociates from IL-1β with a $K_D$ of $2 \times 10^{-7}$ M or less; dissociates from IL-1β with a $K_D$ of $1.1 \times 10^{-7}$ M or less; or dissociates from IL-1β with a $K_D$ of $2.8 \times 10^{-8}$ M or less.

In one embodiment, the antibody, or antigen-binding portion thereof, of the invention neutralizes human IL-1β in a standard in vitro assay with an $ND_{50}$ of 800 nM or less; neutralizes human IL-1β in a standard in vitro MRC5 assay with an $ND_{50}$ of 800 nM or less; neutralizes IL-1β in a standard in vitro assay with an $ND_{50}$ of 200 nM or less; neutralizes IL-1β in a standard in vitro MRC5 assay with an $ND_{50}$ of 200 nM or less.

The invention also includes an antibody, or antigen-binding portion thereof, which dissociates from human IL-1β with a $K_D$ of $5 \times 10^{-5}$ M or less and neutralizes human IL-1β in a standard in vitro MRC5 assay with an $ND_{50}$ of 800 nM or less.

In one embodiment, the antibody, or antigen-binding portion thereof, of the invention comprises variable light chain CDRs as set forth in an amino acid sequence selected from the group consisting of SEQ ID NO: 36, SEQ ID NO: 40, and SEQ ID NO: 48, or variable heavy chain comprising CDRS as set forth in an amino acid sequence selected from the group consisting of SEQ ID NO: 32, SEQ ID NO: 44, SEQ ID NO: 52.

The invention provides an isolated antibody, or an antigen-binding portion thereof, having dual-specificity for human IL-1α and human IL-1β comprising a variable light chain comprising CDRs as set forth in an amino acid sequence selected from the group consisting of SEQ ID NO: 36, SEQ ID NO: 40, and SEQ ID NO: 48, or a variable heavy chain comprising CDRS as set forth in an amino acid sequence selected from the group consisting of SEQ ID NO: 32, SEQ ID NO: 44, SEQ ID NO: 52.

In one embodiment, the antibody, or antigen-binding portion thereof, of the invention dissociates from IL-1α with a $K_D$ of $3.0 \times 10^{-7}$ M or less; dissociates from IL-1α with a $K_D$ of $1.1 \times 10^{-7}$ M or less; dissociates from IL-1α with a $K_D$ of $6 \times 10^{-8}$ M or less; dissociates from IL-1α with a $K_D$ of $4.2 \times 10^{-8}$ M or less; dissociates from IL-1α with a $K_D$ of $1 \times 10^{-8}$ M or less; or dissociates from IL-1α with a $K_D$ of $1 \times 10^{-9}$ M or less.

In one embodiment, the antibody, or antigen-binding portion thereof, of the invention dissociates from human IL-1α with a $K_D$ of $1 \times 10^{-7}$ M or less and neutralizes human IL-1α in a standard in vitro assay with an $ND_{50}$ of 900 nM or less. In one embodiment, the antibody, or antigen-binding portion thereof, neutralizes human IL-1α in a standard in vitro MRC5 assay with an $ND_{50}$ of 900 nM or less. In another embodiment, the antibody, or antigen-binding portion thereof, neutralizes IL-1α in a standard in vitro assay with an $ND_{50}$ of 10 nM or less. In still another embodiment, the antibody, or antigen-binding portion thereof, neutralizes IL-1α in a standard in vitro MRC5 assay with an $ND_{50}$ of 10 nM or less.

In one embodiment of the invention, the isolated antibody, or an antigen-binding portion thereof, comprises a variable light chain comprising CDRs as set forth in an amino acid sequence selected from the group consisting of SEQ ID NO: 12, SEQ ID NO: 24, and SEQ ID NO: 28, or a variable heavy chain comprising CDRS as set forth in an amino acid sequence selected from the group consisting of SEQ ID NO: 4, SEQ ID NO: 8, SEQ ID NO: 16, and SEQ ID NO: 20.

The invention describes an isolated antibody, or an antigen-binding portion thereof, having dual-specificity for human IL-1α and human IL-1β, comprising an IL-1α antigen binding region with a light chain variable sequence comprising a CDR3 selected from the group consisting of SEQ ID NO: 11, SEQ ID NO: 23, and SEQ ID NO: 27 or a heavy chain variable sequence comprising a CDR3 selected from the group consisting of SEQ ID NO: 3, SEQ ID NO: 7, SEQ ID NO: 15, SEQ ID NO: 19, and an IL-1β antigen binding region with a light chain variable sequence comprising a CDR3 selected from the group consisting of SEQ ID NO: 35, SEQ ID NO: 39, and SEQ ID NO: 47 or a heavy chain variable sequence comprising a CDR3 selected from the group consisting of SEQ ID NO: 31, SEQ ID NO: 43, and SEQ ID NO: 51.

In one embodiment, the light chain variable sequence of the IL-1α antigen binding region further comprises a CDR2 selected from the group consisting of SEQ ID NO: 10, SEQ ID NO: 22, and SEQ ID NO: 26. In another embodiment, the light chain variable sequence of the IL-1α antigen binding region further comprises CDR1 selected from the group consisting of SEQ ID NO: 9, SEQ ID NO: 21, and SEQ ID NO: 25. In one embodiment, the light chain variable sequence of the IL-1β antigen binding region further comprises a CDR2 selected from the group consisting of SEQ ID NO: 34, SEQ ID NO: 38, and SEQ ID NO: 46. In another embodiment, the light chain variable sequence of the IL-1α.antigen binding region further comprises CDR1 selected from the group consisting of SEQ ID NO: 33, SEQ ID NO: 37, and SEQ ID NO: 45.

In another embodiment, the heavy chain variable sequence of the IL-1α antigen binding region further comprises a CDR2 selected from the group consisting of SEQ ID NO: 2, SEQ ID NO: 6, SEQ ID NO: 14, and SEQ ID NO: 18. In one embodiment, the heavy chain variable sequence of the IL-1α antigen binding region further comprises CDR1 selected from the group consisting of SEQ ID NO: 1, SEQ ID NO: 5, SEQ ID NO: 13, and SEQ ID NO: 17. In one embodiment, the heavy chain variable sequence of the IL-1β.antigen binding region further comprises a CDR2 selected from the group consisting of SEQ ID NO: 30, SEQ ID NO: 43, and SEQ ID NO: 50. In one embodiment, the heavy chain variable sequence of the IL-1α.antigen binding region further comprises CDR1 selected from the group consisting of SEQ ID NO: 29, SEQ ID NO: 41, and SEQ ID NO: 49.

The invention also provides a dual-specific, isolated antibody, or antigen-binding portion thereof, comprising an IL-1α antigen binding region and an IL-1β antigen binding region, wherein the antibody, or antigen-binding portion thereof, comprises a heavy chain variable region and a light chain variable region combination selected from the group consisting of a heavy chain variable region comprising CDRs as set forth in SEQ ID NO: 16 (ABT1-96) and a light chain variable region comprising CDRs as set forth in SEQ ID NO: 40 (ABT2-46); light chain variable region comprising CDRs as set forth in SEQ ID NO: 24 (ABT1-122) and a heavy chain variable region comprising CDRs as set forth in SEQ ID NO: 52 (ABT2-108); a light chain variable region comprising CDRs as set forth in SEQ ID NO: 28 (ABT1-141) and a heavy chain variable region comprising CDRs as set forth in SEQ ID NO: 52 (ABT2-108); a light chain variable region comprising CDRs as set forth in SEQ ID NO: 28 (ABT1-141) and a heavy chain variable region comprising CDRs as set forth in SEQ ID NO: 44 (ABT2-65); a heavy chain variable region comprising CDRs as set forth in SEQ ID NO: 16 (ABT1-96) and a light chain variable region comprising CDRs as set forth in SEQ ID NO: 36 (ABT2-42); a light chain variable region comprising CDRs as set forth in SEQ ID NO: 12 (ABT1-95) and a heavy chain variable region comprising CDRs as set forth in SEQ ID NO: 32 (ABT2-13); a light chain variable region comprising CDRs as set forth in SEQ ID NO: 24 (ABT1-122) and a heavy chain variable region comprising CDRs as set forth in SEQ ID NO: 44 (ABT2-65); and a heavy chain variable region comprising CDRs as set forth in SEQ ID NO: 20 (ABT1-98) and a light chain variable region comprising CDRs as set forth in SEQ ID NO: 48 (ABT2-76).

In one embodiment, the invention provides antibody, or antigen-binding portion thereof, comprising an IL-1α antigen binding region and/or an IL-1β antigen binding region, wherein the antibody comprises SEQ ID NO: 4, SEQ ID NO: 8, SEQ ID NO: 12, SEQ ID NO: 16, SEQ ID NO: 20, SEQ ID NO: 24, SEQ ID NO: 28, SEQ ID NO: 32, SEQ ID NO: 36, SEQ ID NO: 40, SEQ ID NO: 44, SEQ ID NO: 48, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63 SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO:100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO:11, SEQ ID NO:112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO:130, SEQ ID NO: 131, SEQ ID NO: 132, and SEQ ID NO: 133, or CDRs from said sequences.

In one embodiment, the antibody, or antigen-binding portion thereof, of the invention has an IgG1 or an IgG4 heavy chain constant region.

In one embodiment, the antibody, or antigen-binding portion thereof, of the invention is an antibody fragment selected from the group consisting of a Fab, a Fab', a Fab$_2$, a Fab'$_2$, an Fd, an Fd', a single chain Fv (scFv), an scFv$_a$, and a domain antibody (dAb).

In one embodiment, the antibody, or antigen-binding portion thereof, of the invention is human.

The invention also provides a pharmaceutical composition comprising the antibody, or antigen-binding portion thereof, of the invention, and a pharmaceutically acceptable carrier.

In one embodiment, the pharmaceutical composition of the invention further comprises at least one additional therapeutic agent for treating a disorder in which IL-1α/IL-1β activity is detrimental.

The invention also provides a method for inhibiting human IL-1α/IL-1β activity comprising contacting human IL-1α and IL-1β with the antibody, or antigen-binding portion thereof, of the invention such that human IL-1α/IL-1β activity is inhibited.

The invention includes a method for inhibiting human IL-1α/IL-1β activity in a human subject suffering from a disorder in which IL-1α/IL-1β activity is detrimental, comprising administering to the human subject the antibody, or antigen-binding portion thereof, of the invention such that human IL-1α/IL-1β activity in the human subject is inhibited.

In one embodiment, the disorder in which IL-1α/IL-1β activity is detrimental is selected from the group consisting of an autoimmune disease, an intestinal disorder, a skin disorder, a neurological disorder, and a metabolic disorder.

In one embodiment, the disorder in which IL-1α/IL-1β activity is detrimental is selected from the group consisting of rheumatoid arthritis, Crohn's disease, multiple sclerosis, insulin dependent diabetes, mellitus, and psoriasis.

In one embodiment, the antibody, or antigen binding portion thereof, of the invention is administered to the subject with an additional therapeutic agent.

The invention describes a single domain antibody (dAb) comprising an amino acid sequence selected from the group consisting of SEQ ID NO: 4, SEQ ID NO: 8, SEQ ID NO: 12, SEQ ID NO: 16, SEQ ID NO: 20, SEQ ID NO: 24, SEQ ID NO: 28, SEQ ID NO: 32, SEQ ID NO: 36, SEQ ID NO: 40, SEQ ID NO: 44, SEQ ID NO: 48, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63 SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO:100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO:130, SEQ ID NO: 131, SEQ ID NO: 132, and SEQ ID NO: 133.

The invention also describes an isolated nucleic acid encoding a light chain CDR3 domain selected from the group consisting of SEQ ID NO: 11, SEQ ID NO: 23, and SEQ ID NO: 27. In one embodiment, the nucleic acid of the invention encodes an antibody light chain variable region. In one embodiment, the isolated nucleic acid of the invention comprises a CDR2 domain of the light chain variable region comprises the amino acid sequence selected from the group consisting of SEQ ID NO: 10, SEQ ID NO: 22, and SEQ ID NO: 26. In one embodiment, the isolated nucleic acid of the invention comprises the CDR1 domain of the light chain variable region comprises the amino acid sequence selected from the group consisting of SEQ ID NO: 9, SEQ ID NO: 21, and SEQ ID NO: 25.

The invention also describes an isolated nucleic acid encoding a heavy chain CDR3 domain selected from the group consisting of SEQ ID NO: 3, SEQ ID NO: 7, SEQ ID NO: 15, and SEQ ID NO: 19. In one embodiment, the nucleic acid encodes an antibody heavy chain variable region. In one embodiment, the CDR2 domain of the heavy chain variable region comprises the amino acid sequence selected from the group consisting of SEQ ID NO: 2, SEQ ID NO: 6, SEQ ID NO: 14, and SEQ ID NO: 18. In one embodiment, the CDR1 domain of the heavy chain variable region comprises the amino acid sequence selected from the group consisting of SEQ ID NO: 1, SEQ ID NO: 5, SEQ ID NO: 13, and SEQ ID NO: 17.

The invention also provides an isolated nucleic acid encoding a light chain CDR3 domain selected from the group consisting of SEQ ID NO: 35, SEQ ID NO: 39, and SEQ ID NO: 47. In one embodiment, the nucleic acid encodes an antibody light chain variable region. In one embodiment, the CDR2 domain of the light chain variable region comprises the amino acid sequence selected from the group consisting of SEQ ID NO: 34, SEQ ID NO: 38, and SEQ ID NO: 46. In one embodiment, the CDR1 domain of the light chain variable region comprises the amino acid sequence selected from the group consisting of SEQ ID NO: 33, SEQ ID NO: 37, and SEQ ID NO: 45.

The invention provides an isolated nucleic acid encoding a heavy chain CDR3 domain selected from the group consisting of SEQ ID NO: 31, SEQ ID NO: 43, and SEQ ID NO: 51. In one embodiment, the nucleic acid encodes an antibody heavy chain variable region. In one embodiment, the CDR2 domain of the heavy chain variable region comprises the amino acid sequence selected from the group consisting of SEQ ID NO: 30, SEQ ID NO: 42, and SEQ ID NO: 50. In one embodiment, the CDR1 domain of the heavy chain variable region comprises the amino acid sequence selected from the group consisting of SEQ ID NO: 29, SEQ ID NO: 41, and SEQ ID NO: 49.

The invention describes an isolated nucleic acid encoding a CDR3 domain comprising an amino acid sequence selected from the group consisting of SEQ ID NO: 3, SEQ ID NO 7, SEQ ID NO: 11, SEQ ID NO: 15, SEQ ID NO: 19, SEQ ID NO: 23, SEQ ID NO: 27, SEQ ID NO: 31, SEQ ID NO: 35, SEQ ID NO: 39, SEQ ID NO: 43, SEQ ID NO: 47, and SEQ ID NO: 51.

The invention also provides an isolated nucleic acid encoding an antibody light chain variable region comprising the amino acid sequence selected from the group consisting of SEQ ID NO: 12, SEQ ID NO: 24, SEQ ID NO: 28, SEQ ID NO: 36, SEQ ID NO: 40, and SEQ ID NO: 48. In one embodiment, the nucleic acid encodes the antibody light chain variable region and an antibody light chain constant region The invention also provides an isolated nucleic acid encoding an antibody heavy chain variable region comprising the amino acid sequence selected from the group consisting of SEQ ID NO: 4, SEQ ID NO 8, SEQ ID NO: 16, SEQ ID NO: 20, SEQ ID NO: 32, SEQ ID NO: 44, and SEQ ID NO: 52. In one embodiment, the nucleic acid encodes the antibody heavy chain variable region and an antibody heavy chain constant region.

The invention also provides a recombinant expression vector encoding an antibody light chain having a variable region comprising an amino acid sequence selected from the group consisting of SEQ ID NO: 12, SEQ ID NO: 24, and SEQ ID NO: 28; and an antibody heavy chain having a variable region comprising an amino acid sequence selected from the group consisting of SEQ ID NO: 32, SEQ ID NO: 44, and SEQ ID NO: 52.

The invention also provides a recombinant expression vector encoding an antibody heavy chain having a variable region comprising an amino acid sequence selected from the group consisting of SEQ ID NO: 4, SEQ ID NO: 8, and SEQ ID NO: 16; and an antibody light chain having a variable region comprising an amino acid sequence selected from the group consisting of SEQ ID NO: 36, SEQ ID NO: 40, and SEQ ID NO: 48.

The nucleic acid and amino acid sequences described herein are also included in the invention. In one embodiment, sequences which are at least 80%, 85%, 90%, 95%, 98%, or 99% identical to those described herein are included in invention. In one embodiment, the invention provides an isolated nucleic acid encoding an antibody light chain variable region comprising the amino acid sequence selected from the group consisting of SEQ ID NO: 12, SEQ ID NO: 24, SEQ ID NO: 28, SEQ ID NO: 36, SEQ ID NO: 40, SEQ ID NO: 48, SEQ ID NO: 94, SEQ ID NO: 95, SEQ ID NO: 96, SEQ ID NO: 97, SEQ ID NO: 98, SEQ ID NO: 99, SEQ ID NO:100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO:111, SEQ ID NO:112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO:130, SEQ ID NO: 131, SEQ ID NO: 132, and SEQ ID NO: 133. In one embodiment, the invention provides an isolated nucleic acid encoding an antibody heavy chain variable region comprising the amino acid sequence selected from the group consisting of SEQ ID NO: 4, SEQ ID NO 8, SEQ ID NO: 16, SEQ ID NO: 20, SEQ ID NO: 32, SEQ ID NO: 44, SEQ ID NO: 52, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63 SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, and SEQ ID NO: 92. Also included in the invention are nucleic acids set forth in SEQ ID NO: 134 to 843. Polypeptides encoded by the nucleic acids of SEQ ID NOs: 134 to 843 are also included in the invention.

The invention provides a recombinant expression vector comprising a stuffer sequence and a nucleic acid sequence encoding a heavy or light chain constant region. In one embodiment, the gene of interest is an antibody heavy or light chain variable region. Such vectors may be used to express full length heavy or light chains of an antibody, by cloning a heavy or light chain variable sequence into the insertion site of the vector, which is operably linked to a constant region. In another embodiment, the vector comprises an antibody heavy chain constant region is murine or human, e.g., murine or human lambda, human kappa human IgG3, IgA, IgE, IgM, murine IgG2b, murine IgG3, and an Fc domain. In a further embodiment, the antibody heavy constant region further comprises an alanine mutation at position 234, 235, 237, or any combination thereof. IN still another embodiment, the antibody light chain constant region is either a human kappa isotype or a human lambda isotype. In still another embodiment, the antibody heavy constant region is selected from the group consisting of gamma1, z, a; gamma1, z, non-a; gamma2, n+; gamma2, n–; and gamma 4.

In one embodiment, the vector of the invention may be used to express a fusion protein, e.g., an Fc fusion protein.

The invention also provides an expression vector comprising an episomal origin of replication; an insertion site for inserting a nucleic acid sequence encoding a gene of interest; a stuffer sequence at the insertion site; and a nucleic acid encoding an antibody heavy or light chain constant region. In one embodiment, the stuffer sequence comprises the restriction enzyme sites NruI, FspAI, or a combination thereof at the 5' end of the stuffer sequence. In another embodiment, the stuffer sequence comprises the restriction enzyme sites AfeI, SnaBI, BsiWI, HpaI, SalI, or a combination thereof at the 3' end of the stuffer sequence. In one embodiment, the stuffer sequence comprises a nucleic acid sequence having at least 80%, 90%, 95%, 98%, or 99% identity to the sequence set forth at nucleotides 124 to 1100 of SEQ ID NO: 844.

The vector of the invention may also include certain features desirable for protein expression. For example, the vector may includes an episomal origin of replication is an SV40 origin of replication. In one embodiment, the vector comprises a promoter operably linked to the insertion site, wherein the promoter is an EF-1α promoter.

In one embodiment, the invention provides a nucleic acid comprising the recombinant expression vector, e.g., SEQ ID NOs: 844 to 855. Sequences having 80%, 85%, 90%, 95%, 99% identity to the sequences described in SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, and SEQ ID NO: 855 are also included in the invention. The invention also provides a pEF-BOS recombinant expression vector comprising a stuffer sequence which is inbetween an upstream signal sequence and a downstream Ig constant region sequence.

The invention also includes a host cell into which the recombinant expression vector of the invention has been introduced.

The invention further provides a method of synthesizing a human antibody that binds human IL-1α and IL-1β comprising culturing the host cell of the invention in a culture medium until a human antibody that binds human IL-1α and IL-1β is synthesized by the cell.

BRIEF DESCRIPTION OF THE DRAWINGS

FIG. 2 discloses the "HCDR1" sequences as SEQ ID NOS 49 and 856-859, the "HCDR2" sequences as SEQ ID NOS 50 and 860-874 and the "HCDR3" sequences as SEQ ID NOS 51 and 875-885, all respectively, in order of appearance.

FIG. 3 discloses the "CDR1" sequences as SEQ ID NOS 49 and 1165-1168, the "CDR2" sequences as SEQ ID NOS 50 and 1172, 1174, 1176-1177 and 1181 and the "CDR3" sequences as SEQ ID NOS 51 and 1184, 1186-1187, 1190 and 1194, all respectively, in order of appearance.

FIGS. 8A and 8B show Fab library sorting for ABT2-108 affinity maturation.

FIG. 18A discloses SEQ ID NOS 925, 927, 926, 928, 929, 931, 930 and 932, respectively, in order of appearance and FIG. 18B discloses SEQ ID NOS 925, 933, 926, 934, 935, 937, 936, 938, 929, 939, 930 and 940, respectively, in order of appearance.

DETAILED DESCRIPTION OF THE INVENTION

I. Definitions

Figure 1:
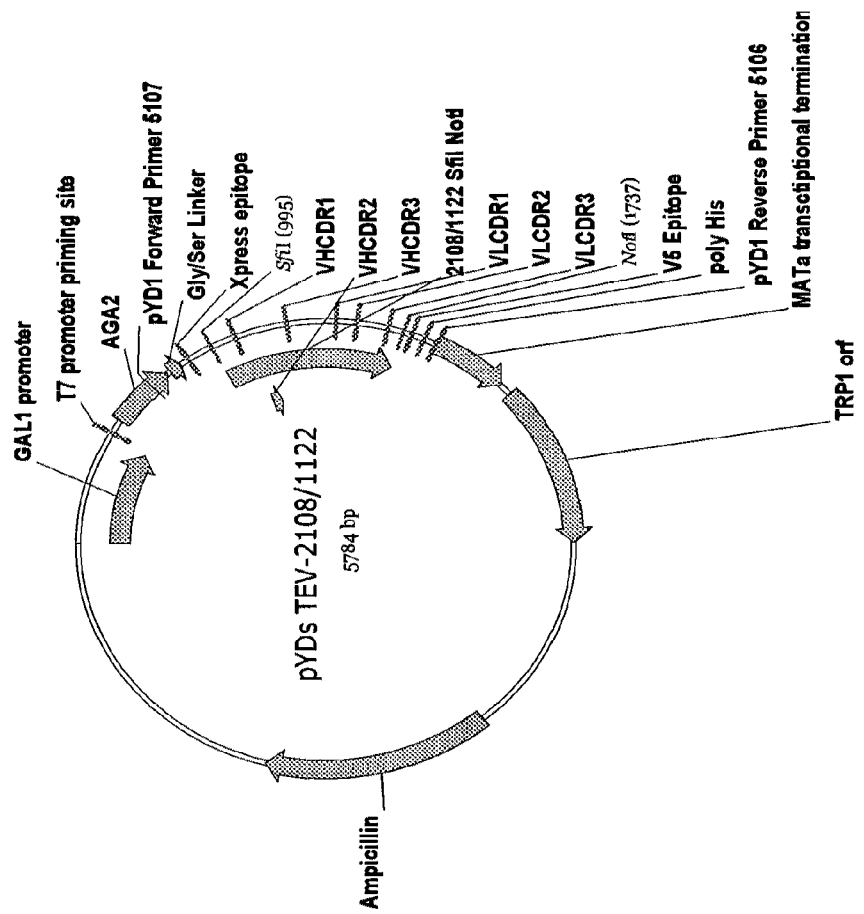
FIG. 1 shows a schematic of a plasmid map of pYDs-TEV-2-108/1-122.

In order that the present invention may be more readily understood, certain terms are first defined.

The term "IL-1" as used herein refers to interleukin-1. The term "IL-1" is intended to include both IL-1α and IL-1β.

The term "antibody" as referred to herein includes whole antibodies and any antigen binding fragment (i.e., "antigen-binding portion") or single chains thereof. An "antibody" refers to a glycoprotein comprising at least two heavy (H) chains and two light (L) chains inter-connected by disulfide bonds, or an antigen binding portion thereof. Each heavy chain is comprised of a heavy chain variable region (abbreviated herein as $V_H$) and a heavy chain constant region. The heavy chain constant region is comprised of three domains, CH1, CH2 and CH3. Each light chain is comprised of a light chain variable region (abbreviated herein as $V_L$) and a light chain constant region. The light chain constant region is comprised of one domain, CL. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (Clq) of the classical complement system.

The term "antigen-binding portion" of an antibody (or simply "antibody portion"), as used herein, refers to one or more fragments of an antibody that retain the ability to specifically bind to an antigen (e.g., IL-1α, IL-1β). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the $V_L$, $V_H$, CL and CH1 domains; (ii) a F(ab')$_2$ fragment, a bivalent fragment comprising two Fab fragments linked by a disulfide bridge at the hinge region; (iii) a Fd fragment consisting of the $V_H$ and $C_{H1}$ domains; (iv) a Fv fragment consisting of the $V_L$ and $V_H$ domains of a single arm of an antibody, (v) a dAb fragment (Ward et al., (1989) Nature 341:544-546), which consists of a $V_H$ or $V_L$ domain; and (vi) an isolated complementarity determining region (CDR). Furthermore, although the two domains of the Fv fragment, VL and $V_H$, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding portion" of an antibody. These antibody fragments are obtained using conventional techniques known to those with skill in the art, and the fragments are screened for utility in the same manner as are intact antibodies. In one embodiment if the invention, the antibody fragment is selected from the group consisting of a Fab, an Fd, an Fd', a single chain Fv (scFv), an scFv$_a$, and a domain antibody (dAb).

Still further, an antibody or antigen-binding portion thereof may be part of a larger immunoadhesion molecules, formed by covalent or noncovalent association of the antibody or antibody portion with one or more other proteins or peptides. Examples of such immunoadhesion molecules include use of the streptavidin core region to make a tetrameric scFv molecule (Kipriyanov et al. (1995) *Human Antibodies and Hybridomas* 6:93-101) and use of a cysteine residue, a marker peptide and a C-terminal polyhistidine tag to make bivalent and biotinylated scFv molecules (Kipriyanov et al. (1994) *Mol. Immunol.* 31:1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion molecules can be obtained using standard recombinant DNA techniques.

Two antibody domains are "complementary" where they belong to families of structures which form cognate pairs or groups or are derived from such families and retain this feature. For example, a VH domain and a VL domain of an antibody are complementary; two VH domains are not complementary, and two VL domains are not complementary. Complementary domains may be found in other members of the immunoglobulin superfamily, such as the Vα and Vβ (or gamma and delta) domains of the T-cell receptor The term "domain" refers to a folded protein structure which retains its tertiary structure independently of the rest of the protein. Generally, domains are responsible for discrete functional properties of proteins, and in many cases may be added, removed or transferred to other proteins without loss of function of the remainder of the protein and/or of the domain. By single antibody variable domain is meant a folded polypeptide domain comprising sequences characteristic of antibody variable domains. It therefore includes complete antibody variable domains and modified variable domains, for example in which one or more loops have been replaced by sequences which are not characteristic of antibody variable domains, or antibody variable domains which have been truncated or comprise N- or C-terminal extensions, as well as folded fragments of variable domains which retain at least in part the binding activity and specificity of the full-length domain.

Variable domains of the invention may be combined to form a group of domains; for example, complementary domains may be combined, such as VL domains being combined with VH domains. Non-complementary domains may also be combined. Domains may be combined in a number of ways, involving linkage of the domains by covalent or non-covalent means.

A "dAb" or "domain antibody" refers to a single antibody variable domain ($V_H$ or $V_L$) polypeptide that specifically binds antigen.

An "isolated dual-specific antibody", or an "isolated antibody," as used herein, is intended to refer to an antibody that is substantially free of other antibodies having different antigenic specificities (e.g., an isolated antibody that specifically binds IL-1α/IL-1β that is substantially free of antibodies that specifically bind antigens other than IL-1α). Moreover, an isolated antibody may be substantially free of other cellular material and/or chemicals.

As referred to herein, the terms "dual-specific antibody" or "an antibody having dual-specificity" means an antibody comprising two antigen-binding sites or regions, a first binding site or region having affinity for a first antigen or epitope and a second binding site or region having binding affinity for a second antigen or epitope that is distinct from the first. In one embodiment, the heavy chain variable domain comprises one antigen binding region, i.e., IL-1α or IL-1β, and the light chain variable domain comprises a further antigen binding region, i.e., IL-1α or IL-1β, such that the antibody has dual-epitope specificity for IL-1α and IL-1β. In addition, the invention also includes within its scope dual-specific $V_H/V_L$ combinations and $V_L/V_L$ combinations.

As used herein, the term "antigen binding region" or "antigen binding site" refers to the portion(s) of an antibody molecule, or antigen binding portion thereof, which contains the amino acid residues that interact with an antigen and confers on the antibody its specificity and affinity for the antigen. In one embodiment, the antibody of the invention comprises two antigen binding regions, one which is specific for IL-1α and another which is specific for IL-1β.

The term "epitope" is meant to refer to that portion of any molecule capable of being recognized by and bound by an antibody at one or more of the antibody's antigen binding regions. In the context of the present invention, first and second "epitopes" are understood to be epitopes which are not the same and are not bound by a single monospecific antibody, or antigen-binding portion thereof. In the invention, the first and second epitopes are advantageously on different antigens, IL-1α or IL-1β. Likewise, the first and second antigens are advantageously not the same.

A "neutralizing antibody," as used herein, is intended to refer to an antibody whose binding to a particular antigen(s), i.e., IL-1α or IL-1β, results in inhibition of the biological activity of the antigen. Inhibition of the biological activity of IL-1α or IL-1β can be assessed by measuring one or more indicators of IL-1α or IL-1β activity, such as IL-1α or IL-1β-induced cytotoxicity (either in vitro or in vivo), or IL-1α or IL-1β binding to IL-1α or IL-1β receptors. These indicators of IL-1α/IL-1β activity can be assessed by one or more standard in vitro or in vivo assays known in the art (for example see Example 5). In one embodiment, the ability of a dual-specific antibody to neutralize both IL-1α and IL-1β activity is assessed by inhibition of IL-1α and IL-1β in human embryonic lung fibroblasts, MRC-5 cells.

The "$ND_{50}$" value of an antibody, or antigen-binding portion thereof, refers to the concentration of antibody resulting in a one-half maximal inhibition of the given cytokine activity on a responsive cell line.

As used herein, the term "EC50" is defined as the concentration of an antibody, or antigen-binding portion thereof, that results in 50% of a measured biological effect. For example, the EC50 of a therapeutic agent having a measurable biological effect may comprise the value at which the agent displays 50% of the biological effect. The term "IC50" is defined as the concentration of an antibody, or antigen-binding portion thereof, that results in 50% inhibition of a measured effect.

The term "surface plasmon resonance", as used herein, refers to an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson et al. (1993) Ann. Biol. Clin. 51:19-26; Jonsson et al. (1991) Biotechniques 11:620-627; Johnsson et al. (1995) J. Mol. Recognit. 8: 125-131; and Johnnson et al. (1991) Anal. Biochem. 198:268-277.

The term "$K_{off}$", as used herein, is intended to refer to the off rate constant for dissociation of an antibody from the antibody/antigen complex.

The term "$K_d$" or "$K_D$" as used herein, is intended to refer to the dissociation constant of a particular antibody-antigen interaction, which is obtained from the ratio of $k_d$ to $k_a$ (i.e., $k_d/k_a$) and is expressed as a molar concentration (M). $K_D$ values for antibodies can be determined using methods well established in the art. A preferred method for determining the $K_D$ of an antibody is by using surface plasmon resonance, preferably using a biosensor system such as a Biacore® system.

A "monoclonal antibody" as used herein is intended to refer to an antibody obtained from a population of substantially homogeneous antibodies, i.e., the individual antibodies comprising the population are identical except for possible naturally occurring mutations that may be present in minor amounts. Monoclonal antibodies are highly specific. Furthermore, in contrast to polyclonal antibody preparations that typically include different antibodies directed against different determinants (epitopes), each monoclonal antibody is directed against a single determinant on the antigen. The modifier "monoclonal" is not to be construed as requiring production of the antibody by any particular method.

The phrase "recombinant antibody" refers to antibodies that are prepared, expressed, created or isolated by recombinant means, such as antibodies expressed using a recombinant expression vector transfected into a host cell, antibodies isolated from a recombinant, combinatorial antibody library, antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of particular immunoglobulin gene sequences (such as human immunoglobulin gene sequences) to other DNA sequences. Examples of recombinant antibodies include chimeric, CDR-grafted and humanized antibodies.

The term "human antibody" refers to antibodies having variable and constant regions corresponding to, or derived from, human germline immunoglobulin sequences as described by, for example, Kabat et al. (See Kabat, et al. (1991) Sequences of Proteins of Immunological Interest, Fifth Edition, U.S. Department of Health and Human Services, NIH Publication No. 91-3242). The human antibodies of the invention, however, may include amino acid residues not encoded by human germline immunoglobulin sequences (e.g., mutations introduced by random or site-specific mutagenesis in vitro or by somatic mutation in vivo), for example in the CDRs and in particular CDR3.

Recombinant human antibodies of the invention have variable regions, and may also include constant regions, derived from human germline immunoglobulin sequences (See Kabat et al. (1991) Sequences of Proteins of Immunological Interest, Fifth Edition, U.S. Department of Health and Human Services, NIH Publication No. 91-3242). In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo. In certain embodiments, however, such recombinant antibodies are the result of selective mutagenesis or backmutation or both.

The term "backmutation" refers to a process in which some or all of the somatically mutated amino acids of a human antibody are replaced with the corresponding germline residues from a homologous germline antibody sequence. The heavy and light chain sequences of a human antibody of the invention are aligned separately with the germline sequences in the VBASE database to identify the sequences with the highest homology. Differences in the human antibody of the invention are returned to the germline sequence by mutating defined nucleotide positions encoding such different amino acid. The role of each amino acid thus identified as candidate for backmutation should be investigated for a direct or indirect role in antigen binding and any amino acid found after mutation to affect any desirable characteristic of the human antibody should not be included in the final human antibody. To minimize the number of amino acids subject to backmutation those amino acid positions found to be different from the closest germline sequence but identical to the corresponding amino acid in a second germline sequence can remain, provided that the second germline sequence is identical and colinear to the sequence of the human antibody of the invention for at least 10, preferably 12 amino acids, on both sides of the amino acid in question. Backmutation may occur at any stage of antibody optimization.

The term "chimeric antibody" refers to antibodies which comprise heavy and light chain variable region sequences from one species and constant region sequences from another species, such as antibodies having murine heavy and light chain variable regions linked to human constant regions.

The term "CDR-grafted antibody" refers to antibodies which comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences.

The term "humanized antibody" refers to antibodies which comprise heavy and light chain variable region sequences from a non-human species (e.g., a mouse) but in which at least a portion of the VH and/or VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences.

The term "nucleic acid molecule", as used herein, is intended to include DNA molecules and RNA molecules. A nucleic acid molecule may be single-stranded or double-stranded, but preferably is double-stranded DNA.

The term "isolated nucleic acid molecule", as used herein in reference to nucleic acids encoding antibodies or antibody portions (e.g., VH, VL, CDR3) that bind IL-1α and IL-1β, is intended to refer to a nucleic acid molecule in which the nucleotide sequences encoding the antibody or antibody portion are free of other nucleotide sequences encoding antibodies or antibody portions that bind antigens other than hTNFα, which other sequences may naturally flank the nucleic acid in human genomic DNA. Thus, for example, an isolated nucleic acid of the invention encoding a VH region of an anti-TNFα antibody contains no other sequences encoding other VH regions that bind antigens other than IL-1α and IL-1β.

The term "vector", as used herein, is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., vectors may have a bacterial origin of replication and/or an episomal origin of replication (generally derived from a viral sequence, e.g., SV40). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

As used herein, the term "episomally replicating vector" or "episomal vector" refers to a vector which is typically and very preferably not integrated into the genome of the host cell, but exists in parallel. An episomally replicating vector, as used herein, is replicated during the cell cycle and in the course of this replication the vector copies are distributed statistically in the resulting cells depending on the number of the copies present before and after cell division. Preferably, the episomally replicating vector may take place in the nucleus of the host cell, and preferably replicates during S-phase of the cell cycle. Moreover, the episomally replicating vector is replicated at least once, i.e. one or multiple times, in the nucleus of the host cell during S-phase of the cell cycle. In a very preferred embodiment, the episomally replicating vector is replicated once in the nucleus of the host cell during S-phase of the cell cycle.

As used herein, the terms "origin of replication sequences" or "origin of replication," used interchangeably herein, refer to sequences which, when present in a vector, initiate replication. An origin of replication may be recognized by a replication initiation factor or, alternatively, by a DNA helicase.

The "gene of interest" as used herein, refers to an exogenous DNA sequence which is added to the vector of the invention. The gene of interest, for example, may comprise a coding sequence which can be either spaced by introns or which is a cDNA encoding the open reading frame. The region of the vector to which the gene of interest is cloned is referred to herein as an "insertion site." Preferably, the gene of interest comprises a portion of the antibody or fusion protein that is expressed using a vector of the invention. For example, the heavy chain variable region of the antibody ABT2-108, i.e., the gene of interest, may cloned into the vector of the invention which comprises a heavy chain constant region In one embodiment of the invention, the vector comprises an antibody light or heavy chain constant region which is 3' to the insertion site for the gene of interest and is operably linked thereto. Thus, in one embodiment, the gene of interest is a variable region of a light or heavy chain of an antibody which is operably linked to the antibody light or heavy chain constant region encoded in the vector of the invention.

The term "promoter" includes any nucleic acid sequence sufficient to direct transcription in a eukaryotic cell, including inducible promoters, repressible promoters and constitutive promoters. Typically a promoter includes elements that are sufficient to render promoter-dependent gene expression controllable in a cell type-specific, tissue-specific or temporal-specific manner, or inducible by external signals or agents. Such elements can be located in the 5' or 3' or intron sequence regions of a particular gene. Ordinarily, gene expression will be constitutive, although regulatable promoters can be employed in the present invention if desired. Gene expression can also be controlled by transcription-regulation using heat, light, or metals, such as by the use of metallothionine genes or heat shock genes.

"Upstream" and "downstream" are terms used to describe the relative orientation between two elements present in a nucleotide sequence or vector. An element that is "upstream" of another is located in a position closer to the 5' end of the sequence (i.e., closer to the end of the molecule that has a phosphate group attached to the 5' carbon of the ribose or deoxyribose backbone if the molecule is linear) than the other element. An element is said to be "downstream" when it is located in a position closer to the 3' end of the sequence (i.e., the end of the molecule that has an hydroxyl group attached to the 3' carbon of the ribose or deoxyribose backbone in the linear molecule) when compared to the other element.

As used herein, the term "stuffer sequence" refers to a nucleic acid sequence, preferably in a vector, which is flanked by restriction enzyme sites at both the 5' and 3' ends. The stuffer sequence is located in a vector at the insertion site for the nucleic acid encoding the gene of interest. During the cloning process, the stuffer sequence is digested away from the vector using the appropriate restriction enzymes, and the nucleic acid encoding the gene of interest is ligated or homologously recombined into the vector at the former position of the stuffer sequence. Preferably, the stuffer sequence is large enough to provide sufficient distance between the 5' and 3' restriction enzyme sites so that the restriction enzyme can efficiently cut the vector. In addition, it is preferred that the length of the stuffer sequence is different than the size of the nucleic acid encoding the gene of interest, e.g., a stuffer sequence of about 300 base pairs or less or about 400 base pairs or more may be used for a nucleic acid encoding the gene of interest which is about 350 base pairs. In another embodiment, the stuffer sequence is about 1 kb in size.

The term "recombinant host cell" (or simply "host cell"), as used herein, is intended to refer to a cell into which a recombinant expression vector has been introduced. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

The term "repertoire" refers to a collection of diverse variants, for example polypeptide variants which differ in their primary sequence. A library used in the present invention will encompass a repertoire of polypeptides comprising at least 1000 members.

The term "library" refers to a mixture of heterogeneous polypeptides or nucleic acids. The library is composed of members, each of which have a single polypeptide or nucleic acid sequence. To this extent, library is synonymous with repertoire. Sequence differences between library members are responsible for the diversity present in the library. The library may take the form of a simple mixture of polypeptides or nucleic acids, or may be in the form of organisms or cells, for example bacteria, viruses, animal or plant cells and the like, transformed with a library of nucleic acids. Preferably, each individual organism or cell contains only one or a limited number of library members. Advantageously, the nucleic acids are incorporated into expression vectors, in order to allow expression of the polypeptides encoded by the nucleic acids. In a preferred aspect, therefore, a library may take the form of a population of host organisms, each organism containing one or more copies of an expression vector containing a single member of the library in nucleic acid form which can be expressed to produce its corresponding polypeptide member. Thus, the population of host organisms has the potential to encode a large repertoire of genetically diverse polypeptide variants.

Various aspects of the invention are described in further detail in the following subsections.

II. IL-1α/IL-1β Dual-Specific Antibodies

The invention provides isolated, dual-specific antibodies, or antigen binding portions thereof, that bind human IL-1α and IL-1β with high affinity and neutralizing capacity. In a preferred embodiment, the antibody, or antigen-binding fragment thereof, is human. Preferably, the antibodies of the invention are recombinant, neutralizing anti-IL-1α and anti-IL-1β. In one embodiment, the invention provides an isolated, dual-specific antibody, or an antigen-binding portion thereof, which dissociates from human IL-1α with a $K_D$ of $1\times10^{-7}$ M or less and neutralizes human IL-1α in a standard in vitro MRC5 assay with an $ND_{50}$ of 900 nM or less, and dissociates from human IL-1β with a $K_D$ of $5\times10^{-5}$ M or less, and neutralizes human IL-1β in a standard in vitro MRC5 assay with an $ND_{50}$ of 800 nM or less. In a preferred embodiment, the IL-1α/IL-1β dual-specific antibody, or antigen-binding portion thereof, binds human IL-1α and IL-1β (hIL-1α and hIL-1β), but does not bind mouse IL-1α or mouse IL-1β. In the case that the variable domains are selected from V-gene repertoires selected for instance using phage display technology as herein described, then these variable domains can comprise a universal framework region, such that is they may be recognised by a specific generic ligand as herein defined. The use of universal frameworks, generic ligands and the like is described in WO99/20749. In the present invention, reference to phage display includes the use of both phage and/or phagemids.

The dual-specific antibodies of the invention may comprise variable regions which are derived from antibodies directed against IL-1α and IL-1β. Alternatively, the antibodies of the invention may be derived from a repertoire of single antibody domains such as those expressed on the surface of filamentous bacteriophage. Selection may be performed as described below in section III and in the Examples provided herein.

The invention provides single domain antibodies which are have neutralizing and affinity properties specific for IL-1α or IL-1β, as summarized in Tables 8 and 61 to 64, as well as the Examples.

Dual-specific antibodies, or antigen-binding portions thereof, according to the present invention preferably comprise combinations of heavy and light chain domains. For example, the dual specific antibody, or antigen-binding portion thereof, may comprise a $V_H$ domain and a $V_L$ domain, which may be linked together in the form of an scFv. In addition, the antibody, or antigen-binding portion thereof, may comprise one or more $C_H$ or $C_L$ domains. For example, the antibody, or antigen-binding portion thereof, may comprise a $C_H1$ domain, $C_H2$ or $C_H3$ domain, and/or a $C_L$ domain, $C\mu1$, $C\mu2$, $C\mu3$ or $C\mu4$ domains, or any combination thereof. A hinge region domain may also be included. Such combinations of domains may, for example, mimic natural antibodies, such as IgG or IgM, or fragments thereof, such as Fv, scFv, Fab or F(ab')$_2$ molecules. Other structures, such as a single arm of an IgG molecule comprising $V_H$, $V_L$, $C_H1$ and $C_L$ domains, are envisaged.

Preferably, the dual specific antibody, or antigen-binding portion thereof, of the invention comprises only two variable domains although several such antibodies, or antigen-binding portions thereof, may be incorporated together into the same protein, for example two such antibodies, or antigen-binding portions thereof, can be incorporated into an IgG or a multimeric immunoglobulin, such as IgM. Alternatively, in another embodiment a plurality of dual specific ligands are combined to form a multimer. For example, two different dual specific ligands are combined to create a tetra-specific molecule.

It will be appreciated by one skilled in the art that the light and heavy variable regions of a dual-specific antibodies, or antigen-binding portions thereof, produced according to the methods described herein and known in the art, may be on the same polypeptide chain, or alternatively, on different polypeptide chains. In the case that the variable regions are on different polypeptide chains, then they may be linked via a linker, generally a flexible linker (such as a polypeptide chain), a chemical linking group, or any other method known in the art.

In one embodiment, the present invention provides dual specific antibodies, or antigen-binding portions thereof, which comprise at least two complementary variable domains, e.g., a VH and a VL domain. In another embodiment, the present invention provides dual specific antibodies, or antigen-binding portions thereof, which comprise at least two non-complementary variable domains. For example, the antibody, or antigen-binding portion thereof, may comprise a pair of VH domains or a pair of VL domains. Advantageously, the domains are of non-camelid origin; preferably they are human domains or comprise human framework regions (FWs) and one or more heterologous CDRs. CDRs and framework regions are those regions of an immunoglobulin variable domain as defined in the Kabat database of Sequences of Proteins of Immunological Interest.

Dual-specific antibodies of the invention may include variable heavy and light chain amino acid regions described in SEQ ID NOs: 4, 8, 12, 16, 20, 24, 28, 32, 36, 40, 44, 48, and 52 (see Table 61 and Example 3 for a summary). Dula specific antibodies may also include any of the variable heavy and light chain amino acid regions described in SEQ ID NOs: 53 to 133.

Pairings of the single domain antibodies described in SEQ ID NOs: 4, 8, 12, 16, 20, 24, 28, 32, 36, 40, 44, 48, and 52, as well as any of the variable sequences described in SEQ ID NOs: 53 to 133, are also included in the invention. Examples of dual-specific IL-1α and IL-1β antibodies are described in the Examples, including Example 5 and Table 9. In one embodiment, the invention provides a dual-specific, isolated antibody, or antigen-binding portion thereof, comprising an IL-1α antigen binding region and an IL-1β antigen binding region, wherein the antibody, or antigen-binding portion thereof, comprises a heavy chain variable region and a light chain variable region combination comprising a heavy chain variable region comprising CDRs as set forth in SEQ ID NO: 16 (ABT1-96) and a light chain variable region comprising CDRs as set forth in SEQ ID NO: 40 (ABT2-46); a light chain variable region comprising CDRs as set forth in SEQ ID NO: 24 (ABT1-122) and a heavy chain variable region comprising CDRs as set forth in SEQ ID NO: 52 (ABT2-108); a light chain variable region comprising CDRs as set forth in SEQ ID NO: 28 (ABT1-141) and a heavy chain variable region comprising CDRs as set forth in SEQ ID NO: 52 (ABT2-108); a light chain variable region comprising CDRs as set forth in SEQ ID NO: 28 (ABT1-141) and a heavy chain variable region comprising CDRs as set forth in SEQ ID NO: 44 (ABT2-65); a heavy chain variable region comprising CDRs as set forth in SEQ ID NO: 16 (ABT1-96) and a light chain variable region comprising CDRs as set forth in SEQ ID NO: 36 (ABT2-42); a light chain variable region comprising CDRs as set forth in SEQ ID NO: 12 (ABT1-95) and a heavy chain variable region comprising CDRs as set forth in SEQ ID NO: 32 (ABT2-13); a light chain variable region comprising CDRs as set forth in SEQ ID NO: 24 (ABT1-122) and a heavy chain variable region comprising CDRs as set forth in SEQ ID NO: 44 (ABT2-65); or a heavy chain variable region comprising CDRs as set forth in SEQ ID NO: 20 (ABT1-98) and a light chain variable region comprising CDRs as set forth in SEQ ID NO: 48 (ABT2-76).

It is known in the art that antibody heavy and light chain CDR3 domains play an important role in the binding specificity/affinity of an antibody for an antigen. Accordingly, in another aspect, the invention pertains to antibodies, including human antibodies, that have slow dissociation kinetics for association with either IL-1α or IL-1β and that have light and heavy chain CDR3 domains that structurally are identical to or related to those identified herein, including those CDR3 domains described in SEQ ID NOs: 11, 23, 27, 3, 7, 15, and 19.

In one aspect, the invention pertains to a dual-specific antibody, or antigen-binding portion thereof, of the invention is preferably selected to have desirable binding kinetics (e.g., high affinity, low dissociation, slow off-rate, strong neutralizing activity) for IL-1α and IL-1β, to which the antibody specifically binds. For example, the dual-specific antibody, or portion thereof, may bind IL-1α and IL-1β with a $k_{off}$ rate constant of $0.1\ s^{-1}$ or less, more preferably a $k_{off}$ rate constant of $1\times10^{-2}\ s^{-1}$ or less, even more preferably a $k_{off}$ rate constant of $1\times10^{-3}\ s^{-1}$ or less, even more preferably a $k_{off}$ rate constant of $1\times10^{-4}\ s^{-1}$ or less, or even more preferably a $k_{off}$ rate constant of $1\times10^{-5}\ s^{-1}$ or less, as determined by surface plasmon resonance. In one embodiment, the isolated, dual-specific antibody, or an antigen-binding portion thereof, dissociates from human IL-1α with a $K_D$ of about $1\times10^{-7}$ M to about $1\times10^{-8}$ M or less and dissociates from human IL-1β with a $K_D$ of about $5\times10^{-5}$ M to about $1\times10^{-9}$ M or less. Ranges intermediate to the above recited constants, e.g., $4.0\times10^{-8}$ M, are also intended to be part of this invention. For example, ranges of values using a combination of any of the above recited values as upper and/or lower limits are intended to be included.

In one embodiment, the antibody, or antigen-binding portion thereof, dissociates from IL-1β with a $K_D$ of $5.4\times10^{-5}$ M or less; dissociates from IL-1β with a $K_D$ of $2.8\times10^{-6}$ M or less; dissociates from IL-1β with a $K_D$ of $1.3\times10^{-6}$ M or less; dissociates from IL-1β with a $K_D$ of $9.3\times10^{-7}$ M or less; dissociates from IL-1β with a $K_D$ of $2\times10^{-7}$ M or less; dissociates from IL-1β with a $K_D$ of $1.1\times10^{-7}$ M or less; or dissociates from IL-1β with a $K_D$ of $2.8\times10^{-8}$ M or less. Ranges intermediate to the above recited constants, e.g., $K_D$ of $1.7\times10^{-7}$ M or less, are also intended to be part of this invention. For example, ranges of values using a combination of any of the above recited values as upper and/or lower limits are intended to be included.

In one embodiment, the antibody, or antigen-binding portion, dissociates from IL-1α with a $K_D$ of $1\times10^{-8}$ M or less; dissociates from IL-1α with a $K_D$ of $1\times10^{-9}$ M or less; dissociates from IL-1α with a $K_D$ of 40-86 nM or less; dissociates from IL-1α with a $K_D$ of 20-42 nM or less; dissociates from IL-1α with a $K_D$ of 32-42 nM or less; dissociates from IL-1α with a $K_D$ of 7-12 nM or less; dissociates from IL-1α with a $K_D$ of $3.0\times10^{-7}$ M or less; dissociates from IL-1α with a $K_D$ of $1.1\times10^{-7}$ M or less; dissociates from IL-1α with a $K_D$ of $6.1\times10^{-8}$ M or less; dissociates from IL-1α with a $K_D$ of $6\times10^{-8}$ M or less; dissociates from IL-1α with a $K_D$ of $4.2\times10^{-8}$ M or less; dissociates from IL-1α with a $K_D$ of $1.3\times10^{-8}$ M or less; or dissociates from IL-1α with a $K_D$ of $1.1\times10^{-9}$ M or less. Ranges intermediate to the above recited constants, e.g., $K_D$ of $1.7\times10^{-7}$ M or less, are also intended to be part of this invention. For example, ranges of values using a combination of any of the above recited values as upper and/or lower limits are intended to be included.

It should be noted that the aforementioned affinity properties may also apply to single domain antibodies of the invention which bind and neutralize IL-1α or IL-1β. Surface plasmon resonance analysis may be used for determining kinetic values, including $K_D$ and $k_{off}$ values.

The IL-1α/IL-1β dual-specific antibody, or antigen-binding portion thereof, of the invention may exhibit a strong capacity to neutralize both hIL-1α and hIL-1β activity, as determined using a standard in vitro or in vivo assay (see also Examples, including Example 5). For example, in one embodiment if the invention, IL-1α/IL-1β antibodies neutralize human IL-1α in a standard in vitro assay with $ND_{50}$ values of about 900 nM to about 10 nM or less. The antibodies of the invention are also able to neutralize human IL-1β in a standard in vitro assay with $ND_{50}$ values of about 800 nM to about 200 nM or less. Alternatively or additionally, a dual-specific antibody, or antigen binding portion thereof, may inhibit the activity of one, and more preferably both, of IL-1α and/or IL-1β with an $ND_{50}$ of $1\times10^{-6}$ M or less, even more preferably with an $ND_{50}$ of $1\times10^{-7}$ M or less, even more preferably with an $ND_{50}$ of $1\times10^{-8}$ M or less, even more preferably with an $ND_{50}$ of $1\times10^{-9}$ M or less, even more preferably with an $ND_{50}$ of $1\times10^{-10}$ M or less, or even more preferably with an $ND_{50}$ of $1\times10^{-11}$ M or less. In one embodiment, the antibody, or antigen-binding portion, neutralizes human IL-1α in a standard in vitro assay with an $ND_{50}$ of 900 nM or less, and/or neutralizes human IL-1β in a standard in vitro assay with an $ND_{50}$ of 800 nM or less. In one embodiment, the antibody, or antigen-binding portion thereof, neutralizes IL-1α in a standard in vitro assay with an $ND_{50}$ of 10 nM or less. In one embodiment, the antibody, or antigen-binding portion thereof, neutralizes IL-1β in a standard in vitro assay with an $ND_{50}$ of 200 nM or less. In one embodiment, the antibody, or antigen-binding portion thereof, neutralizes IL-1α in a standard in vitro assay with an $ND_{50}$ of 10 nM or less. In one embodiment, the antibody, or antigen-binding portion thereof, neutralizes IL-1β in a standard in vitro assay with an $ND_{50}$ of 200 nM or less. Ranges intermediate to the above recited values, e.g., $ND_{50}$ of 80 nM or less, $ND_{50}$ of $4.0\times10^{-10}$ M or less, are also intended to be part of this invention. For example, ranges of values using a combination of any of the above recited values as upper and/or lower limits are intended to be included.

In one embodiment, neutralization properties of an antibody, or antigen-binding portion thereof, may be determined using an in vitro MRC-5 cell assay.

It should be noted that the aforementioned neutralization properties may also apply to single domain antibodies of the invention which bind and neutralize IL-1α or IL-1β.

In yet another embodiment, an antibody of the invention comprises heavy and light chain variable regions comprising amino acid sequences that are homologous to the amino acid sequences of the preferred antibodies described herein, and wherein the antibodies retain the desired functional properties of the IL-1α/IL-1β dual-specific antibodies of the invention. For example, the invention provides an isolated antibody, or antigen binding portion thereof, comprising a heavy chain variable region and a light chain variable region, wherein (a) the heavy chain variable region comprises an amino acid sequence that is at least 80% homologous to an amino acid sequence selected from the group consisting of SEQ ID NOs: 4, 16, 20, 32, 44, 52, or 53 to 92; (b) the light chain variable region comprises an amino acid sequence that is at least 80% homologous to an amino acid sequence selected from the group consisting of SEQ ID NOs: 8, 12, 24, 28, 36, 40, 48, or 93 to 133; and (c) the antibody specifically binds to IL-1α/IL-1β and exhibits at least one of the functional properties described herein, preferably several of the functional properties described herein. Also included in the invention is an isolated antibody, or antigen binding portion thereof, comprising two heavy (or two light) chain variable regions that specifically binds to IL-1α/IL-1β.

In other embodiments, the VH and/or VL amino acid sequences may be 85%, 90%, 95%, 96%, 97%, 98% or 99% homologous to the sequences set forth herein, including SEQ ID NOs: 52 to 133. An antibody having VH and VL regions having high (i.e., 80% or greater) homology to the VH and VL regions of the sequences set forth above, can be obtained by mutagenesis (e.g., site-directed or PCR-mediated mutagenesis) of nucleic acid molecules encoding SEQ ID NOs: 4, 8, 12, 16, 20, 24, 28, 32, 36, 40, 44, 48, and 52 to 133, followed by testing of the encoded altered antibody for retained function (i.e., affinity and neutralization properties) using the functional assays described herein.

In another embodiment, the invention provides nucleic acid sequences which may be 85%, 90%, 95%, 96%, 97%, 98% or 99% homologous to the sequences set forth herein, including SEQ ID NOs: 134 to 843.

As used herein, the percent homology between two amino acid sequences is equivalent to the percent identity between the two sequences. The percent identity between the two sequences is a function of the number of identical positions shared by the sequences (i.e., % homology=# of identical positions/total# of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of Meyers and Miller (Comput. Appl. Biosci., 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. 48:444-453 (1970)) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul et al. (1990) J. Mol. Biol. 215:403-10. BLAST protein searches can be performed with the XBLAST program, score=50, wordlength=3 to obtain amino acid sequences homologous to the antibody molecules of the invention. To obtain gapped alignments for comparison purposes, Gapped BLAST can be utilized as described in Altschul et al. (1997) Nucleic Acids Res. 25(17):3389-3402. When utilizing BLAST and Gapped BLAST programs, the default parameters of the respective programs (e.g., XBLAST and NBLAST) can be used. See http://www.ncbi.nlm.nih.gov.

In certain embodiments, an antibody of the invention comprises a heavy chain variable region comprising CDR1, CDR2 and CDR3 sequences and a light chain variable region comprising CDR1, CDR2 and CDR3 sequences, wherein one or more of these CDR sequences comprise specified amino acid sequences based on the preferred antibodies described herein, or conservative modifications thereof, and wherein the antibodies retain the desired functional properties of the anti-IL-1α/IL-1β dual-specific antibodies of the invention.

The skilled artisan will appreciate that substitution of other amino acids within the CDR3 domains identified herein may be possible while still retaining the low off rate constant of the antibody, in particular substitutions with conservative amino acids.

Accordingly, the invention provides an isolated antibody, or antigen binding portion thereof, comprising a heavy chain variable region comprising CDR1, CDR2, and CDR3 sequences and a light chain variable region comprising CDR1, CDR2, and CDR3 sequences, wherein: (a) the heavy chain variable region CDR3 sequence comprises an amino acid sequence selected from the group consisting of amino acid sequences of SEQ ID NOs: 3, 7, 15, 19, 31, 43, and 51, and conservative modifications thereof; (b) the light chain variable region CDR3 sequence comprises an amino acid sequence selected from the group consisting of amino acid sequences of SEQ ID NOs: 11, 23, 27, 35, 39, and 47, and conservative modifications thereof, and (c) the antibody specifically binds to IL-1α/IL-1β and exhibits at least one of the functional properties described herein, more preferably several of the functional properties described herein, i.e., high affinity and neutralizing for both IL-1α/IL-1β.

In a further embodiment, the heavy chain variable region CDR2 sequence comprises an amino acid sequence selected from the group consisting of amino acid sequences of SEQ ID NOs: 2, 6, 14, 18, 30, 42, and 50, and conservative substitutions thereof, and the light chain variable region CDR2 sequence comprises an amino acid sequence selected from the group consisting of amino acid sequences of SEQ ID NOs: 10, 22, 26, 34, 38, and 46, and conservative modifications thereof. In a still further embodiment, the heavy chain variable region CDR1 sequence comprises an amino acid sequence selected from the group consisting of amino acid sequences of SEQ ID NOs: 1, 5, 13, 17, 29, 41, and 49, and conservative modifications thereof, and the light chain variable region CDR1 sequence comprises an amino acid sequence selected from the group consisting of amino acid sequences of SEQ ID NOs: 9, 21, 25, 33, 37, and 45, and conservative modifications thereof.

A "conservative amino acid substitution" or a "conservative substitution", as used herein, is one in which one amino acid residue is replaced with another amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Substitutions and modifications can be introduced into an antibody of the invention by standard techniques known in the art, such as site-directed mutagenesis and PCR-mediated mutagenesis. Thus, one or more amino acid residues within the CDR regions of an antibody of the invention can be replaced with other amino acid residues from the same side chain family and the altered antibody can be tested for retained function, e.g., affinity or neutralization characteristics, using the functional assays described herein.

Accordingly, another embodiment of the invention pertains to an isolated dual-specific antibody, or antigen binding portion thereof, comprising a heavy chain variable region comprising CDR1, CDR2, and CDR3 sequences comprising an amino acid sequence selected from the group consisting of SEQ ID NOs: 1, 5, 13, 17, 29, 41, and 49, SEQ ID NOs: 2, 6, 14, 18, 30, 42, and 50 and SEQ ID NOs: 3, 7, 15, 19, 31, 43, and 51, respectively, and a light chain variable region comprising CDR1, CDR2, and CDR3 sequences comprising an amino acid sequence selected from the group consisting of SEQ ID NOs: 9, 21, 25, 33, 37, and 45, SEQ ID NOs: 10, 22, 26, 34, 38, and 46 and SEQ ID NOs: 11, 23, 27, 35, 39, and 47, respectively. Thus, such antibodies contain the VH and/or VL CDR sequences of antibodies described herein, yet may contain different framework sequences from these antibodies.

Preferred human framework regions are those encoded by germline gene segments DP47 and DPK9. Advantageously, FW1, FW2 and FW3 of a VH or VL domain have the sequence of FW1, FW2 or FW3 from DP47 or DPK9. The human frameworks may optionally contain mutations, for example up to about 5 amino acid changes or up to about 10 amino acid changes collectively in the human frameworks used in the ligands of the invention.

Such framework sequences can be obtained from public DNA databases or published references that include germline antibody gene sequences. For example, germline DNA sequences for human heavy and light chain variable region genes can be found in the "VBase" human germline sequence database (available on the Internet at www.mrc-cpe.cam.ac.uk/vbase), as well as in Kabat et al. (1991) Sequences of Proteins of Immunological Interest, Fifth Edition, U.S. Department of Health and Human Services, NIH Publication No. 91-3242; Tomlinson, I. M., et al. (1992) "The Repertoire of Human Germline $V_H$ Sequences Reveals about Fifty Groups of $V_H$ Segments with Different Hypervariable Loops" J. Mol. Biol. 227:776-798; and Cox et al. (1994) "A Directory of Human Germ-line $V_H$ Segments Reveals a Strong Bias in their Usage" Eur. J. Immunol. 24:827-836; the contents of each of which are expressly incorporated herein by reference. Preferred framework sequences for use in the antibodies of the invention are those that are structurally similar to the framework sequences used by selected antibodies of the invention. The VH CDR1, 2 and 3 sequences of SEQ ID NOs: 1, 2, 3, 5, 6, 7, 13, 14, 15, 17, 18, 19, 29, 30, 31, 41, 42, 43 49, 50, and 51 and the VL CDR1, 2 and 3 sequences of SEQ ID NOs: 9, 10, 11, 21, 22, 23, 25, 26, 27, 33, 34, 35, 37, 38, 39, 45, 46, and 47, can be grafted onto framework regions that have the same sequence as that found in the germline immunoglobulin gene from which the framework sequence derive, or the CDR sequences can be grafted onto framework regions that contain one or more mutations as compared to the germline sequences. For example, it has been found that in certain instances it is beneficial to mutate residues within the framework regions to maintain or enhance the antigen binding ability of the antibody (see e.g., U.S. Pat. Nos. 5,530,101; 5,585,089; 5,693,762 and 6,180,370 to Queen et al).

In one embodiment, an antibody of the invention may be prepared using an antibody having one or more of the $V_H$ and/or $V_L$ sequences disclosed herein as starting material to engineer a modified antibody, which modified antibody may have altered properties from the starting antibody. An antibody can be engineered by modifying one or more residues within one or both variable regions (i.e., $V_H$ and/or $V_L$), for example within one or more CDR regions and/or within one or more framework regions. Additionally or alternatively, an antibody can be engineered by modifying residues within the constant region(s), for example to alter the effector function(s) of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific naturally occurring antibodies by constructing expression vectors that include CDR sequences from the specific naturally occurring antibody grafted onto framework sequences from a different antibody with different properties (see, e.g., Riechmann et al. (1998) Nature 332:323-327; Jones. et al. (1986) Nature 321:522-525; Queen et al. (1989) Proc. Natl. Acad. See. U.S.A. 86:10029-10033; U.S. Pat. No. 5,225,539 to Winter, and U.S. Pat. Nos. 5,530,101; 5,585,089; 5,693,762 and 6,180,370 to Queen et al.)

Another type of variable region modification is to mutate amino acid residues within the VH and/or VL CDR1, CDR2 and/or CDR3 regions to thereby improve one or more binding properties (e.g., affinity) of the antibody of interest. Site-directed mutagenesis or PCR-mediated mutagenesis can be performed to introduce the mutation(s) and the effect on antibody binding, or other functional property of interest, can be evaluated in in vitro or in vivo assays as described herein and provided in the Examples. Preferably conservative modifications (as discussed above) are introduced. The mutations may be amino acid substitutions, additions or deletions, but are preferably substitutions. Moreover, typically no more than five residues are altered within a CDR region are altered.

Engineered antibodies of the invention include those in which modifications have been made to framework residues within $V_H$ and/or $V_L$, e.g. to improve the properties of the antibody. Typically such framework modifications are made to decrease the immunogenicity of the antibody. For example, one approach is to "backmutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "backmutated" to the germline sequence by, for example, site-directed mutagenesis or PCR-mediated mutagenesis.

Another type of framework modification involves mutating one or more residues within the framework region, or even within one or more CDR regions, to remove T cell epitopes to thereby reduce the potential immunogenicity of the antibody. This approach is also referred to as "deimmunization" and is described in further detail in U.S. patent Publication No. 20030153043 by Carr et al.

In addition or alternative to modifications made within the framework or CDR regions, dual-specific antibodies of the invention may be engineered to include modifications within the Fc region, typically to alter one or more functional properties of the antibody, such as serum half-life, complement fixation, Fc receptor binding, and/or antigen-dependent cellular cytotoxicity. Furthermore, an antibody of the invention may be chemically modified (e.g., one or more chemical moieties can be attached to the antibody) or be modified to alter it's glycosylation, again to alter one or more functional properties of the antibody. Each of these embodiments is described in further detail below. The numbering of residues in the Fc region is that of the EU index of Kabat.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the dual-specific antibody.

In another embodiment, the Fc hinge region of the antibody of the invention is mutated to decrease the biological half life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In another embodiment, the antibody of the invention is modified to increase its biological half life. Various approaches are possible. For example, one or more of the following mutations can be introduced: T252L, T254S, T256F, as described in U.S. Pat. No. 6,277,375 to Ward. Alternatively, to increase the biological half life, the antibody may be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al.

In yet other embodiments, the Fc region is altered by replacing at least one amino acid residue with a different amino acid residue to alter the effector function(s) of the dual-specific antibody. For example, one or more amino acids selected from amino acid residues 234, 235, 236, 237, 297, 318, 320 and 322 can be replaced with a different amino acid residue such that the antibody has an altered affinity for an effector antibody but retains the antigen-binding ability of the parent antibody. The effector antibody to which affinity is altered can be, for example, an Fc receptor or the C1 component of complement. This approach is described in further detail in U.S. Pat. Nos. 5,624,821 and 5,648,260, both by Winter et al.

In another example, one or more amino acids selected from amino acid residues 329, 331 and 322 can be replaced with a different amino acid residue such that the dual-specific antibody has altered C1q binding and/or reduced or abolished complement dependent cytotoxicity (CDC). This approach is described in further detail in U.S. Pat. No. 6,194,551 by Idusogie et al.

In another example, one or more amino acid residues within amino acid positions 231 and 239 are altered to thereby alter the ability of the antibody to fix complement. This approach is described further in PCT Publication WO 94/29351 by Bodmer et al.

In yet another example, the Fc region is modified to increase the ability of the dual-specific antibody to mediate antibody dependent cellular cytotoxicity (ADCC) and/or to increase the affinity of the antibody for an Fcγ receptor by modifying one or more amino acids at the following positions: 238, 239, 248, 249, 252, 254, 255, 256, 258, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439. This approach is described further in PCT Publication WO 00/42072 by Presta. Moreover, the binding sites on human IgG1 for FcγRI, FcγRII, FcγRIII and FcRn have been mapped and variants with improved binding have been described (see Shields et al. (2001) J. Biol. Chem. 276:6591-6604). Specific mutations at positions 256, 290, 298, 333, 334 and 339 were shown to improve binding to FcγRIII. Additionally, the following combination mutants were shown to improve FcγRIII binding: T256A/S298A, S298A/E333A, S298A/K224A and S298A/E333A/K334A.

In still another embodiment, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation. For example, EP 1,176,195 by Hanai et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, Lec13 cells, with reduced ability to attach fucose to Asn(297)-linked carbohydrates, also resulting in hypofucosylation of antibodies expressed in that host cell (see also Shields et al. (2002) J. Biol. Chem. 277:26733-26740). PCT Publication WO 99/54342 by Umana et al. describes cell lines engineered to express glycoprotein-modifying glycosyl transferases (e.g., beta(1,4)-N-acetylglucosaminyltransferase III (GnTIII)) such that antibodies expressed in the engineered cell lines exhibit increased bisecting GlcNac structures which results in increased ADCC activity of the antibodies (see also Umana et al. (1999) Nat. Biotech. 17:176-180).

Another modification of the antibodies herein that is contemplated by the invention is pegylation. An antibody can be pegylated to, for example, increase the biological (e.g., serum) half life of the antibody. To pegylate an antibody, the antibody, or fragment thereof, typically is reacted with polyethylene glycol (PEG), such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies of the invention. See for example, EP 0 154 316 by Nishimura et al. and EP 0 401 384 by Ishikawa et al.

In a further aspect, the present invention provides a composition comprising a dual-specific antibody, or antigen-binding portion thereof, obtainable by a method described herein or known in the art, and a pharmaceutically acceptable carrier, diluent or excipient.

Moreover, the present invention provides a method for the treatment and/or prevention of disease using a dual-specific antibody, or antigen-binding portion thereof, or a composition according to the present invention.

III. Methods of Making IL-1α/IL-1β Dual-Specific Antibodies

Dual-specific antibodies of the invention may be prepared according to established techniques used in the field of antibody engineering. Techniques for the preparation of antibodies, and in particular dual-specific antibodies, are, for example, described in the following reviews and the references cited therein: Winter & Milstein, (1991) Nature 349: 293-299; Plueckthun (1992) Immunological Reviews 130: 151-188; Wright et al., (1992) Crit. Rev. Immunol. 12:125-168; Holliger, P. & Winter, G. (1993) Curr. Op. Biotechn. 4, 446-449; Carter, et al. (1995) J. Hematother. 4, 463-470; Chester, & Hawkins (1995) Trends Biotechn. 13, 294-300; Hoogenboom, H. R. (1997) Nature Biotechnol. 15, 125-126; Fearon, D. (1997) Nature Biotechnol. 15, 618-619; Pluckthun, A. & Pack, P. (1997) Immunotechnology 3, 83-105;

Carter & Merchant (1997) Curr. Opin. Biotechnol. 8, 449-454; Holliger & Winter (1997) Cancer Immunol. Immunother. 45, 128-130.

The invention provides for the selection of variable domains against two different antigens or epitopes, i.e., IL-1α or IL-1β, and subsequent combination of the variable domains into a dual-specific antibody, or antigen-binding portion thereof.

The techniques employed for selection of the IL-1α or IL-1β-specific variable domains employ libraries and selection procedures which are known in the art. Natural libraries (Marks et al. (1991) J. Mol. Biol., 222: 581; Vaughan et al. (1996) Nature Biotech., 14: 309) which use rearranged V genes harvested from human B cells are well known to those skilled in the art. Synthetic libraries (Hoogenboom & Winter (1992) J. Mol. Biol., 227: 381; Barbas et al. (1992) Proc. Natl. Acad. Sci. USA, 89: 4457; Nissim et al. (1994) EMBO J., 13: 692; Griffiths et al. (1994) EMBO J., 13: 3245; De Kruif et al. (1995) J. Mol. Biol., 248: 97) are prepared by cloning immunoglobulin V genes, usually using PCR. Errors in the PCR process can lead to a high degree of randomisation. VH and/or VL libraries may be selected against target antigens or epitopes separately, in which case single domain binding is directly selected for, or together.

A preferred method for making a dual-specific antibody according to the present invention comprises using a selection system in which a repertoire of variable domains is selected for binding to a first antigen or epitope (i.e., IL-1α or IL-1β) and a repertoire of variable domains is selected for binding to a second antigen or epitope (i.e., IL-1α or IL-1β). The selected variable first and second variable domains are then combined and the dual-specific antibody selected for binding to both first and second antigen or epitope.

In one embodiment, the antibody or antigen-binding portion thereof, is identified through a method comprising the general steps of: (a) selecting a first variable domain by its ability to bind to a first epitope (i.e., IL-1α or IL-1β), (b) selecting a second variable region by its ability to bind to a second epitope (i.e., IL-1α or IL-1β), (c) combining the variable domains; and (d) selecting the antibody, or antigen-binding portion thereof, by its ability to bind to said first epitope and to said second epitope.

In a preferred embodiment of the invention, the variable regions are selected from single domain V gene repertoires. Generally the repertoire of single antibody domains is displayed on the surface of filamentous bacteriophage. In a preferred embodiment each single antibody domain is selected by binding of a phage repertoire to antigen.

In a preferred embodiment of the invention each single variable domain may be selected for binding to its target antigen or epitope in the absence of a complementary variable region. In an alternative embodiment, the single variable domains may be selected for binding to its target antigen or epitope in the presence of a complementary variable region. Thus the first single variable domain may be selected in the presence of a third complementary variable domain, and the second variable domain may be selected in the presence of a fourth complementary variable domain. The complementary third or fourth variable domain may be the natural cognate variable domain having the same specificity as the single domain being tested, or a non-cognate complementary domain—such as a "dummy" variable domain.

Library Vector Systems

A variety of selection systems are known in the art which are suitable for use in the present invention. Examples of such systems are described below.

Phage display technology (see, e.g., Smith (1985) Science 228:1315; Scott and Smith (1990) Science 249:386; McCafferty et al. (1990) Nature 348: 552) provides an approach for the selection of antibody polypeptides which bind a desired target from among large, diverse repertoires of antibody polypeptides. Phage display libraries may contain synthetic libraries whereby germline V gene segments are 'rearranged' in vitro (Hoogenboom and Winter (1992) J Mol Bio 227:381; Nissim et al. (1994) EMBO J., 13: 692; Griffiths et al. (1994) EMBO J., 13: 3245; De Kruif et al. (1995) J. Mol. Biol., 248: 97) or where synthetic CDRs are incorporated into a single rearranged V gene (Barbas et al. (1992) PNAs 89:4457). Most often, the antibody polypeptides displayed on the phage comprise antigen-binding antibody fragments. In one embodiment, the antibody polypeptides displayed on the phage are single domains (dAbs).

Bacteriophage lambda expression systems may be screened directly as bacteriophage plaques or as colonies of lysogens, both as previously described (Huse et al. (1989) Science, 246: 1275; Caton and Koprowski (1990) Proc. Natl. Acad. Sci. U.S.A., 87; Mullinax et al. (1990) Proc. Natl. Acad. Sci. U.S.A., 87: 8095; Persson et al. (1991) Proc. Natl. Acad. Sci. U.S.A., 88: 2432) and are of use in the invention. Whilst such expression systems can be used to screen up to $10^6$ different members of a library, they are not really suited to screening of larger numbers (greater than $10^6$ members).

Of particular use in the construction of libraries are selection display systems, which enable a nucleic acid to be linked to the polypeptide it expresses. As used herein, a selection display system is a system that permits the selection, by suitable display means, of the individual members of the library by binding the generic and/or target ligands.

Selection protocols for isolating desired members of large libraries are known in the art, as typified by phage display techniques. Such systems, in which diverse peptide sequences are displayed on the surface of filamentous bacteriophage (Scott and Smith (1990) Science, 249: 386), have proven useful for creating libraries of antibody fragments (and the nucleotide sequences that encoding them) for the in vitro selection and amplification of specific antibody fragments that bind a target antigen (McCafferty et al., WO 92/01047). The nucleotide sequences encoding the VH and VL regions are linked to gene fragments which encode leader signals that direct them to the periplasmic space of E. coli and as a result the resultant antibody fragments are displayed on the surface of the bacteriophage, typically as fusions to bacteriophage coat proteins (e.g., pIII or pVIII). Alternatively, antibody fragments are displayed externally on lambda phage capsids (phagebodies). An advantage of phage-based display systems is that, because they are biological systems, selected library members can be amplified simply by growing the phage containing the selected library member in bacterial cells. Furthermore, since the nucleotide sequence that encode the polypeptide library member is contained on a phage or phagemid vector, sequencing, expression and subsequent genetic manipulation is relatively straightforward.

Methods for the construction of bacteriophage antibody display libraries and lambda phage expression libraries are well known in the art (McCafferty et al. (1990) Nature, 348: 552; Kang et al. (1991) Proc. Natl. Acad. Sci. U.S.A., 88: 4363; Clackson et al. (1991) Nature, 352: 624; Lowman et al. (1991) Biochemistry, 30: 10832; Burton et al. (1991) Proc. Natl. Acad. Sci. U.S.A., 88: 10134; Hoogenboom et al. (1991) Nucleic Acids Res., 19: 4133; Chang et al. (1991) J. Immunol., 147: 3610; Breitling et al. (1991) Gene, 104: 147; Marks et al. (1991) supra; Barbas et al. (1992) supra; Hawkins and Winter (1992) J. Immunol., 22: 867; Marks et al., 1992, J.

Biol. Chem., 267:16007; Lerner et al. (1992) Science, 258: 1313, incorporated herein by reference).

One particularly advantageous approach has been the use of scFv phage-libraries (Huston et al., 1988, Proc. Natl. Acad. Sci. U.S.A., 85: 5879-5883; Chaudhary et al. (1990) Proc. Natl. Acad. Sci. U.S.A., 87:1066-1070; McCafferty et al. (1990) supra; Clackson et al. (1991) Nature, 352: 624; Marks et al. (1991) J. Mol. Biol., 222: 581; Chiswell et al. (1992) Trends Biotech., 10: 80; Marks et al. (1992) J. Biol. Chem., 267). Various embodiments of scFv libraries displayed on bacteriophage coat proteins have been described. Refinements of phage display approaches are also known, for example as described in WO96/06213 and WO92/01047 (Medical Research Council et al.) and WO97/08320 (Morphosys), which are incorporated herein by reference.

Other systems for generating libraries of polypeptides involve the use of cell-free enzymatic machinery for the in vitro synthesis of the library members. In one method, RNA molecules are selected by alternate rounds of selection against a target antibody and PCR amplification (Tuerk and Gold (1990) Science, 249: 505; Ellington and Szostak (1990) Nature, 346: 818). A similar technique may be used to identify DNA sequences which bind a predetermined human transcription factor (Thiesen and Bach (1990) Nucleic Acids Res., 18: 3203; Beaudry and Joyce (1992) Science, 257: 635; WO92/05258 and WO92/14843). In a similar way, in vitro translation can be used to synthesize polypeptides as a method for generating large libraries. These methods which generally comprise stabilized polysome complexes, are described further in WO88/08453, WO90/05785, WO90/07003, WO91/02076, WO91/05058, and WO92/02536. Alternative display systems which are not phage-based, such as those disclosed in WO95/22625 and WO95/11922 (Affymax) use the polysomes to display polypeptides for selection.

A still further category of techniques involves the selection of repertoires in artificial compartments, which allow the linkage of a gene with its gene product. For example, a selection system in which nucleic acids encoding desirable gene products may be selected in microcapsules formed by water-in-oil emulsions is described in WO99/02671, WO00/40712 and Tawfik & Griffiths (1998) Nature Biotechnol 16(7), 652-6. Genetic elements encoding a gene product having a desired activity are compartmentalized into microcapsules and then transcribed and/or translated to produce their respective gene products (RNA or protein) within the microcapsules. Genetic elements which produce gene product having desired activity are subsequently sorted. This approach selects gene products of interest by detecting the desired activity by a variety of means.

Library Construction

Libraries intended for selection, may be constructed using techniques known in the art, for example as set forth above, or may be purchased from commercial sources. Libraries which are useful in the present invention are described, for example, in WO99/20749. Once a vector system is chosen and one or more nucleic acid sequences encoding polypeptides of interest are cloned into the library vector, one may generate diversity within the cloned molecules by undertaking mutagenesis prior to expression; alternatively, the encoded proteins may be expressed and selected, as described above, before mutagenesis and additional rounds of selection are performed. Mutagenesis of nucleic acid sequences encoding structurally optimized polypeptides is carried out by standard molecular methods. Of particular use is the polymerase chain reaction, or PCR, (Mullis and Faloona (1987) Methods Enzymol., 155: 335, herein incorporated by reference). PCR, which uses multiple cycles of DNA replication catalyzed by a thermostable, DNA-dependent DNA polymerase to amplify the target sequence of interest, is well known in the art. The construction of various antibody libraries has been discussed in Winter et al. (1994) Ann. Rev. Immunology 12, 433-55, and references cited therein.

For example, PCR may be performed using template DNA (at least 1 fg; more usefully, 1-1000 ng) and at least 25 pmol of oligonucleotide primers; it may be advantageous to use a larger amount of primer when the primer pool is heavily heterogeneous, as each sequence is represented by only a small fraction of the molecules of the pool, and amounts become limiting in the later amplification cycles. A typical reaction mixture includes: 2 µl of DNA, 25 pmol of oligonucleotide primer, 2.5 W of 10×PCR buffer 1 (Perkin-Elmer, Foster City, Calif.), 0.4 µl of 1.25 µM dNTP, 0.15 µl (or 2.5 units) of Taq DNA polymerase (Perkin Elmer, Foster City, Calif.) and deionized water to a total volume of 25 µl. Mineral oil is overlaid and the PCR is performed using a programmable thermal cycler. The length and temperature of each step of a PCR cycle, as well as the number of cycles, is adjusted in accordance to the stringency requirements in effect. Annealing temperature and timing are determined both by the efficiency with which a primer is expected to anneal to a template and the degree of mismatch that is to be tolerated; obviously, when nucleic acid molecules are simultaneously amplified and mutagenised, mismatch is required, at least in the first round of synthesis. The ability to optimize the stringency of primer annealing conditions is well within the knowledge of one of moderate skill in the art. An annealing temperature of between 30° C. and 72° C. is used. Initial denaturation of the template molecules normally occurs at between 92° C. and 99° C. for 4 minutes, followed by 20-40 cycles consisting of denaturation (94-99° C. for 15 seconds to 1 minute), annealing (temperature determined as discussed above; 1-2 minutes), and extension (72° C. for 1-5 minutes, depending on the length of the amplified product). Final extension is generally for 4 minutes at 72° C., and may be followed by an indefinite (0-24 hour) step at 4° C.

Vector constructs or libraries of vectors containing polynucleotide molecules as described herein can be introduced to selected host cells by any of a number of suitable methods known in the art. For example, vector constructs may be introduced to appropriate bacterial cells by infection, in the case of bacteriophage vector particles such as lambda or M13, or any of a number of transformation methods for plasmid vectors or for bacteriophage DNA.

In one embodiment, a phage displayed repertoire of $V_H$ or $V_L$ domains is screened by panning against either IL-1α or IL-1β.

Combining Single Variable Domains

IL-1α or IL-1β specific domains useful in the invention, once selected, may be combined by a variety of methods known in the art, including by covalent and non-covalent methods.

Preferred methods include the use of polypeptide linkers, as described, for example, in connection with scFv molecules (Bird et al., (1988) Science 242:423-426). Discussion of suitable linkers is provided in Bird et al. Science 242, 423-426; Hudson et al, Journal Immunol Methods 231 (1999) 177-189; Hudson et al, Proc Nat Acad Sci USA 85, 5879-5883. Linkers are preferably flexible, allowing the two single domains to interact. One linker example is a $(Gly_4 Ser)_n$ linker, where n=1 to 8, e.g., 2, 3, 4, 5 or 7. The linkers used in diabodies, which are less flexible, may also be employed (Holliger et al., (1993) PNAS (USA) 90:6444-6448).

In one embodiment, the linker employed is not an immunoglobulin hinge region.

Variable domains may be combined using methods other than linkers. For example, the use of disulphide bridges, provided through naturally-occurring or engineered cysteine residues, may be exploited to stabilise VH-VH, VL-VL or VH-VL dimers (Reiter et al., (1994) Protein Eng. 7:697-704) or by remodelling the interface between the variable domains to improve the "fit" and thus the stability of interaction (Ridgeway et al., (1996) Protein Eng. 7:617-621; Zhu et. al., (1997) Protein Science 6:781-788).

Characterization of IL-1 Antibody

The binding of an antibody to its specific antigens or epitopes can be tested by methods which will be familiar to those skilled in the art and include ELISA.

In a one embodiment of the invention, binding of the single domain of the invention is tested using monoclonal phage ELISA according to standard methods.

Populations of phage produced at each round of selection can be screened for binding by ELISA to the selected antigen or epitope, to identify "polyclonal" phage antibodies. Phage from single infected bacterial colonies from these populations can then be screened by ELISA to identify "monoclonal" phage antibodies. It is also desirable to screen soluble antibody fragments for binding to antigen or epitope, and this can also be undertaken by ELISA using reagents, for example, against a C- or N-terminal tag (see for example Winter et al. (1994) Ann. Rev. Immunology 12, 433-55 and references cited therein.

The diversity of the selected phage monoclonal antibodies may also be assessed by gel electrophoresis of PCR products (Marks et al. 1991, supra; Nissim et al. 1994 supra), probing (Tomlinson et al., 1992) J. Mol. Biol. 227, 776) or by sequencing of the vector DNA.

Assays for detecting IL-1 are known in the art and may be used to determine the ability of a dual-specific antibody for neutralizing IL-1α and/or IL-1β.

Structure of Dual-Specific Antibodies

As described above, an antibody is herein defined as an antibody (for example IgG, IgM, IgA, IgA, IgE) or fragment (Fab, Fv, disulphide linked Fv, scFv, diabody) which comprises at least one heavy and a light chain variable domain, at least two heavy chain variable domains or at least two light chain variable domains. An antibody may be at least partly derived from any species naturally producing an antibody, or created by recombinant DNA technology; whether isolated from serum, B-cells, hybridomas, transfectomas, yeast or bacteria).

In a preferred embodiment of the invention the dual-specific antibody comprises at least one single heavy chain variable domain of an antibody and one single light chain variable domain of an antibody, or two single heavy or light chain variable domains. For example, the antibody may comprise a VH/VL pair, a pair of VH domains, or a pair of VL domains.

The first and the second variable domains of such an antibody may be on the same polypeptide chain. Alternatively they may be on separate polypeptide chains. In the case that they are on the same polypeptide chain they may be linked by a linker, which is preferentially a peptide sequence, as described above.

The first and second variable domains may be covalently or non-covalently associated. In the case that they are covalently associated, the covalent bonds may be disulphide bonds.

In the case that the variable domains are selected from V-gene repertoires selected for instance using phage display technology as herein described, then these variable domains comprise a universal framework region, such that is they may be recognised by a specific generic ligand as herein defined. The use of universal frameworks, generic ligands and the like is described in WO99/20749.

Where V-gene repertoires are used variation in polypeptide sequence is preferably located within the structural loops of the variable domains. The polypeptide sequences of either variable domain may be altered by DNA shuffling or by mutation in order to enhance the interaction of each variable domain with its complementary pair. DNA shuffling is known in the art and taught, for example, by Stemmer, 1994, Nature 370: 389-391 and U.S. Pat. No. 6,297,053, both of which are incorporated herein by reference. Other methods of mutagenesis are well known to those of skill in the art.

According to another aspect of the invention, advantageously, the epitope binding domains identified in the screening process described above, are attached to a "protein skeleton". Advantageously, a protein skeleton according to the invention is an immunoglobulin skeleton.

According to the present invention, the term 'immunoglobulin skeleton' refers to a protein which comprises at least one immunoglobulin fold and which acts as a nucleus for one or more epitope binding domains, as defined herein.

Preferred immunoglobulin skeletons as herein defined includes any one or more of those selected from the following: an immunoglobulin molecule comprising at least (i) the CL (kappa or lambda subclass) domain of an antibody; or (ii) the CH1 domain of an antibody heavy chain; an immunoglobulin molecule comprising the CH1 and CH2 domains of an antibody heavy chain; an immunoglobulin molecule comprising the CH1, CH2 and CH3 domains of an antibody heavy chain; or any of the subset (ii) in conjunction with the CL (kappa or lambda subclass) domain of an antibody. A hinge region domain may also be included. Such combinations of domains may, for example, mimic natural antibodies, such as IgG or IgM, or fragments thereof, such as Fv, scFv, Fab or F(ab')$_2$ molecules. Those skilled in the art will be aware that this list is not intended to be exhaustive.

Linking of the skeleton to the epitope binding domains, as herein defined may be achieved at the polypeptide level, that is after expression of the nucleic acid encoding the skeleton and/or the epitope binding domains. Alternatively, the linking step may be performed at the nucleic acid level. Methods of linking a protein skeleton according to the present invention, to the one or more epitope binding domains include the use of protein chemistry and/or molecular biology techniques which will be familiar to those skilled in the art and are described herein.

Skeletons may be based on immunoglobulin molecules or may be non-immunoglobulin in origin as set forth above. Preferred immunoglobulin skeletons as herein defined includes any one or more of those selected from the following: an immunoglobulin molecule comprising at least (i) the CL (kappa or lambda subclass) domain of an antibody; or (ii) the CH1 domain of an antibody heavy chain; an immunoglobulin molecule comprising the CH1 and CH2 domains of an antibody heavy chain; an immunoglobulin molecule comprising the CH1, CH2 and CH3 domains of an antibody heavy chain; or any of the subset (ii) in conjunction with the CL (kappa or lambda subclass) domain of an antibody. A hinge region domain may also be included. Such combinations of domains may, for example, mimic natural antibodies, such as IgG or IgM, or fragments thereof, such as Fv, scFv, Fab or F(ab')$_2$ molecules. Those skilled in the art will be aware that this list is not intended to be exhaustive.

In a one embodiment of the invention the dual-specific antibody is a single chain Fv fragment. In an alternative embodiment of the invention, the dual-specific antibody consists of a Fab format.

In a further aspect, the present invention provides nucleic acid encoding a dual-specific antibody as herein defined. In another embodiment, the invention provides a nucleic acid encoding a dAb identified herein.

One skilled in the art will appreciate that, depending on the aspect of the invention, both antigens or epitopes may bind simultaneously to the same antibody molecule. Alternatively, they may compete for binding to the same antibody molecule. For example, where both epitopes are bound simultaneously, both variable domains of a dual-specific antibodies are able to independently bind their target epitopes. Where the domains compete, the one variable domain is capable of binding its target, but not at the same time as the other variable domain binds its cognate target; or the first variable domain is capable of binding its target, but not at the same time as the second variable domain binds its cognate target.

The variable regions may be derived from antibodies directed against target antigens or epitopes. Alternatively they may be derived from a repertoire of single antibody domains such as those expressed on the surface of filamentous bacteriophage. Selection may be performed as described above and in the Examples provided herein.

In general, the nucleic acid molecules and vector constructs required for the performance of the present invention may be constructed and manipulated as set forth in standard laboratory manuals, such as Sambrook et al. (1989) Molecular Cloning: A Laboratory Manual, Cold Spring Harbor, USA.

The manipulation of nucleic acids useful in the present invention is typically carried out in recombinant vectors.

Thus in a further aspect, the present invention provides a vector comprising nucleic acid encoding at least a dual-specific antibody as herein defined. In another embodiment, the invention provides a vector comprising a nucleic acid encoding a dAb identified herein.

Methods by which to select or construct and, subsequently, use vectors are well known to one of ordinary skill in the art. Numerous vectors are publicly available, including bacterial plasmids, bacteriophage, artificial chromosomes and episomal vectors. Such vectors may be used for simple cloning and mutagenesis; alternatively gene expression vector is employed. A vector of use according to the invention may be selected to accommodate a polypeptide coding sequence of a desired size, typically from 0.25 kilobase (kb) to 40 kb or more in length A suitable host cell is transformed with the vector after in vitro cloning manipulations. Each vector contains various functional components, which generally include a cloning (or "polylinker") site, an origin of replication and at least one selectable marker gene. If given vector is an expression vector, it additionally possesses one or more of the following: enhancer element, promoter, transcription termination and signal sequences, each positioned in the vicinity of the cloning site, such that they are operatively linked to the gene encoding an antibody according to the invention.

Both cloning and expression vectors generally contain nucleic acid sequences that enable the vector to replicate in one or more selected host cells. Typically in cloning vectors, this sequence is one that enables the vector to replicate independently of the host chromosomal DNA and includes origins of replication or autonomously replicating sequences. Such sequences are well known for a variety of bacteria, yeast and viruses. The origin of replication from the plasmid pBR322 is suitable for most Gram-negative bacteria, the 2 micron plasmid origin is suitable for yeast, and various viral origins (e.g. SV 40, adenovirus) are useful for cloning vectors in mammalian cells. Generally, the origin of replication is not needed for mammalian expression vectors unless these are used in mammalian cells able to replicate high levels of DNA, such as COS cells.

Advantageously, a cloning or expression vector may contain a selection gene also referred to as selectable marker. This gene encodes a protein necessary for the survival or growth of transformed host cells grown in a selective culture medium. Host cells not transformed with the vector containing the selection gene will therefore not survive in the culture medium. Typical selection genes encode proteins that confer resistance to antibiotics and other toxins, e.g. ampicillin, neomycin, methotrexate or tetracycline, complement auxotrophic deficiencies, or supply critical nutrients not available in the growth media.

Since the replication of vectors encoding an antibody according to the present invention is most conveniently performed in *E. coli*, an *E. coli*-selectable marker, for example, the β-lactamase gene that confers resistance to the antibiotic ampicillin, is of use. These can be obtained from *E. coli* plasmids, such as pBR322 or a pUC plasmid such as pUC18 or pUC19.

Expression vectors usually contain a promoter that is recognised by the host organism and is operably linked to the coding sequence of interest. Such a promoter may be inducible or constitutive. The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences.

Promoters suitable for use with prokaryotic hosts include, for example, the β-lactamase and lactose promoter systems, alkaline phosphatase, the tryptophan (trp) promoter system and hybrid promoters such as the tac promoter. Promoters for use in bacterial systems will also generally contain a Shine-Delgarno sequence operably linked to the coding sequence.

The preferred vectors are expression vectors that enable the expression of a nucleotide sequence corresponding to a polypeptide library member. Thus, selection with the first and/or second antigen or epitope can be performed by separate propagation and expression of a single clone expressing the polypeptide library member or by use of any selection display system. As described above, the preferred selection display system is bacteriophage display. Thus, phage or phagemid vectors may be used, eg pIT1 or pIT2. Leader sequences useful in the invention include pelB, stII, ompA, phoA, bla and pelA. One example are phagemid vectors which have an *E. coli* origin of replication (for double stranded replication) and also a phage origin of replication (for production of single-stranded DNA). The manipulation and expression of such vectors is well known in the art (Hoogenboom and Winter (1992) supra; Nissim et al. (1994) supra). Briefly, the vector contains a β-lactamase gene to confer selectivity on the phagemid and a lac promoter upstream of a expression cassette that consists (N to C terminal) of a pelB leader sequence (which directs the expressed polypeptide to the periplasmic space), a multiple cloning site (for cloning the nucleotide version of the library member), optionally, one or more peptide tag (for detection), optionally, one or more TAG stop codon and the phage protein pIII. Thus, using various suppressor and non-suppressor strains of *E. coli* and with the addition of glucose, iso-propyl thio-β-D-galactoside (IPTG) or a helper phage, such as VCS M13, the vector is able to replicate as a plasmid with no expression, produce large quantities of the polypeptide library member only or produce phage, some of which contain at least one copy of the polypeptide-pIII fusion on their surface.

The invention provides improved vectors for expressing an antibody heavy or light chain, or an antigen-binding portion thereof. The vectors of the invention may also be used for library screening, as they provide efficient cloning for screening purposes. In one embodiment, the invention provides an improved recombinant expression vector comprising a stuffer sequence, e.g., 1 kb, which is in between an upstream signal sequence and a downstream Ig constant region sequence. In order to make an antibody heavy or light chain construct, the stuffer sequence in the chosen master template (or vector) is removed by restriction enzyme digestion followed by inserting the desired antibody V domain sequence (e.g., VH, Vκ, or Vγ). The resulting plasmid construct is easily propogated in and purified from *E. coli* and can be used to express antibody by co-transfecting both a heavy chain and a light chain construct in mammalian cells, such as COS cells. Examples of vector sequences encompassed by the invention are provided in SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, and SEQ ID NO: 855. It should be noted that nucleic acid sequences that are 80% identical, 90% identical, 95% identical, 98% identical, and 99% identical to SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, and SEQ ID NO: 855 are also contemplated as part of the invention. An example of the vector of the invention is also provided in FIG. 19.

The size of the stuffer sequence will vary depending on the gene of interest being ligated or recombined into the vector. Generally, the stuffer sequence cannot be too small, i.e., less than 100 bp, as it should be large enough to visualize on an analytical agarose gel to confirm the excision of the stuffer. In theory, however, the theoretical lower limitation may be about 10 base pairs, as this size may provide enough distance between the two sites for efficient enzyme cutting (without confirmation by gel electrophoresis). While there is no upper limit in size to the stuffer sequence, it is not desirable to have a stuffer sequence which is larger than the vector itself, especially for distinguishing between the stuffer and linear cut vector on an agarose gel. In one embodiment, the stuffer sequence is less than 3 kilobases, but larger than 10 base pairs. In another embodiment, the stuffer sequence is less than 3 kilobases, but larger than 50 base pairs. In another embodiment, the stuffer sequence is less than 3 kilobases, but larger than 80 base pairs. In another embodiment, the stuffer sequence is less than 3 kilobases, but larger than 100 base pairs. In one embodiment, the stuffer sequence is less than 1 kilobase, but larger than 10 base pairs. In another embodiment, the stuffer sequence is less than 1 kilobase, but larger than 50 base pairs. In another embodiment, the stuffer sequence is less than 1 kilobase, but larger than 80 base pairs. In another embodiment, the stuffer sequence is less than 1 kilobases, but larger than 100 base pairs. Examples of stuffer sequences are described in Table 36, and include nucleotides 124 to 1103 of SEQ ID NO: 855, 124 to 1100 of SEQ ID NOs: 844 to 849, and 132 to 1100 of SEQ ID NO: 850. Also included within the invention are nucleic acids having high homology to the stuffer sequences described herein, i.e., nucleic acid sequences that are 80%, 90%, 95%, 98%, or 99% identical to the stuffer sequences described herein.

Figure 18:
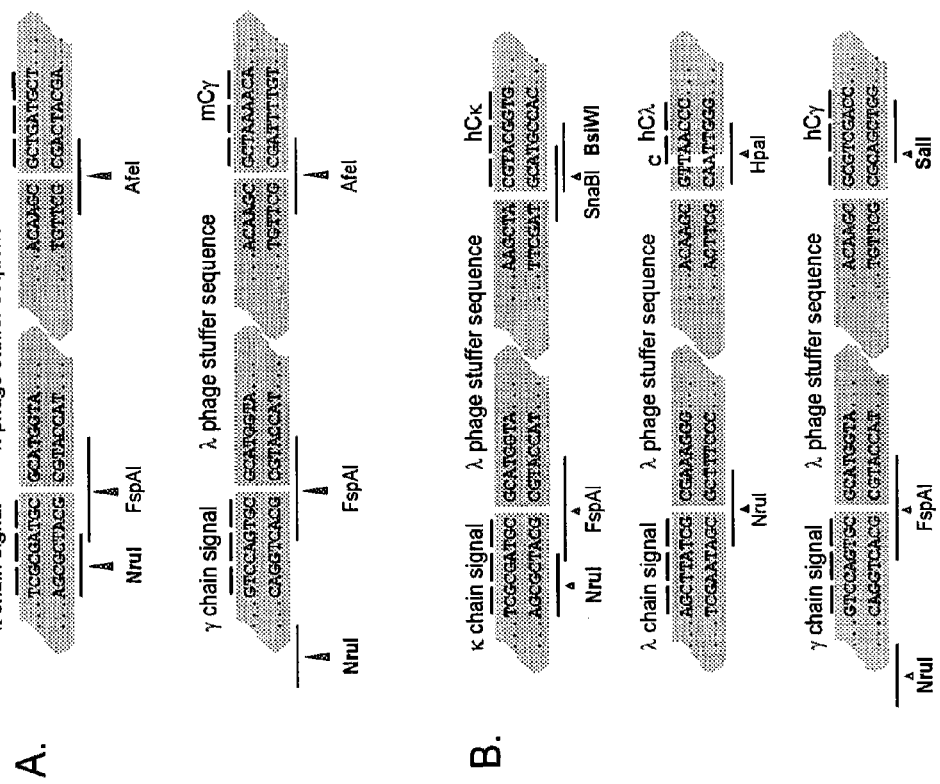
FIGS. 18A and 18B show the design and use of mouse and human pBOS templates, respectively.

In one embodiment, the stuffer sequence used in the vector of the invention contains certain restriction enzyme sites at the 5', 3' or both the 5' and 3' ends. Examples of such sites include, but are not limited to, NruI, FspAI, or a combination thereof at the 5' end of the stuffer sequence and AfeI, SnaBI, BsiWI, HpaI, SalI, or a combination thereof at the 3' end of the stuffer sequence. Stuffer sequences having advantageous restriction sites at the 5' and 3' ends are also described in FIG. 18.

Another important feature of the vector of the invention is that it contains heavy or light chain constant region sequences which may be operably linked to an insertion site for a nucleic acid encoding a variable chain region or another protein (e.g., to form an Fc fusion protein). The vector may contain any isotype of antibody, e.g., IgG, IgA, IgE, IgM, and IgD. In one embodiment, the constant region corresponds to a murine heavy or light chain sequence, including murine lambda, murine IgG2b, and murine IgG3. Alternatively, the constant region may be human, as described in the vector of Example 4. Examples of constant regions that may be used in the vector are described in Tables 36 and 37, as well as in the vectors described in SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, and SEQ ID NO: 855.

In one embodiment, the vector comprises an episomal origin of replication which is an SV40 origin of replication. The SV40 (Simian Virus 40) origin of replication (described in FIG. 19) requires a single viral protein, the large T-antigen, for initiation of replication of the vector via this origin. The SV40 origin of replication may be used in episomal vectors to replicate and maintain said vector (see Calos (1996) *Trends Genetics* 12: 462; Harrison et al. (1994) *J Virol* 68:1913; Cooper et al. (1997) *PNAS* 94:6450; and Ascenziono et al. (1997) *Cancer Lett* 118:135).

In one embodiment, the vector of the invention may be used to express an Fc fusion protein. As used herein, the terms "linked," "fused" or "fusion" are used interchangeably. These terms refer to the joining together of two more elements or components, by whatever means including chemical conjugation or recombinant means. An "in-frame fusion" or "operably linked" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature.) Although the reading frame is thus made continuous throughout the fused segments, the segments may be physically or spatially separated by, for example, an in-frame linker sequence.

As used herein, the term "Fc region" includes amino acid sequences derived from the constant region of an antibody heavy chain. In some embodiments, an Fc region includes a polypeptide comprising the constant region of an antibody excluding the first constant region immunoglobulin domain.

The terms "Fc fusion" or "Fc fusion protein", as used herein, include a protein wherein one or more proteins, polypeptides or small molecules is operably linked to an Fc region or derivative thereof. The term "Fc fusion" as used herein is intended to be synonymous with terms such as "Ig fusion", "Ig chimera", and "receptor globulin" (sometimes with dashes) as used in the prior art (Chamow et al., 1996, *Trends Biotechnol* 14:52-60; Ashkenazi et al., 1997, *Curr Opin Immunol* 9:195-200). An Fc fusion combines one or more Fc regions, or variant(s) thereof, of an immunoglobulin with a fusion partner, which in general can be any protein, polypeptide, peptide, or small molecule. In some embodiments, the role of the non-Fc part of an Fc fusion, i.e., the fusion partner, may be to mediate target binding, and thus it can be functionally analogous to the variable regions of an antibody.

Construction of vectors encoding antibodies according to the invention employs conventional ligation techniques. Isolated vectors or DNA fragments are cleaved, tailored, and religated in the form desired to generate the required vector. If desired, analysis to confirm that the correct sequences are present in the constructed vector can be performed in a known fashion. Suitable methods for constructing expression vectors, preparing in vitro transcripts, introducing DNA into host cells, and performing analyses for assessing expression and function are known to those skilled in the art. The presence of a gene sequence in a sample is detected, or its amplification and/or expression quantified by conventional methods, such as Southern or Northern analysis, Western blotting, dot blotting of DNA, RNA or protein, in situ hybridisation, immunocytochemistry or sequence analysis of nucleic acid or protein molecules. Those skilled in the art will readily envisage how these methods may be modified, if desired.

Techniques for determining nucleic acid and amino acid "sequence identity" also are known in the art. Typically, such techniques include determining the nucleotide sequence of the mRNA for a gene and/or determining the amino acid sequence encoded thereby, and comparing these sequences to a second nucleotide or amino acid sequence. In general, "identity" refers to an exact nucleotide-to-nucleotide or amino acid-to-amino acid correspondence of two polynucleotides or polypeptide sequences, respectively. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100. An approximate alignment for nucleic acid sequences is provided by the local homology algorithm of Smith and Waterman, Advances in Applied Mathematics 2:482-489 (1981). This algorithm can be applied to amino acid sequences by using the scoring matrix developed by Dayhoff, Atlas of Protein Sequences and Structure, M. O. Dayhoff ed., 5 suppl. 3:353-358, National Biomedical Research Foundation, Washington, D.C., USA, and normalized by Gribskov, Nucl. Acids Res. 14(6):6745-6763 (1986). An exemplary implementation of this algorithm to determine percent identity of a sequence is provided by the Genetics Computer Group (Madison, Wis.) in the "BestFit" utility application. The default parameters for this method are described in the Wisconsin Sequence Analysis Package Program Manual, Version 8 (1995) (available from Genetics Computer Group, Madison, Wis.). A preferred method of establishing percent identity in the context of the present invention is to use the MPSRCH package of programs copyrighted by the University of Edinburgh, developed by John F. Collins and Shane S. Sturrok, and distributed by IntelliGenetics, Inc. (Mountain View, Calif.). From this suite of packages the Smith-Waternan algorithm can be employed where default parameters are used for the scoring table (for example, gap open penalty of 12, gap extension penalty of one, and a gap of six). From the data generated the "Match" value reflects "sequence identity." Other suitable programs for calculating the percent identity or similarity between sequences are generally known in the art.

Two nucleic acid fragments are considered to "selectively hybridize" as described herein. The degree of sequence identity between two nucleic acid molecules affects the efficiency and strength of hybridization events between such molecules. A partially identical nucleic acid sequence will at least partially inhibit a completely identical sequence from hybridizing to a target molecule. Inhibition of hybridization of the completely identical sequence can be assessed using hybridization assays that are well known in the art (e.g., Southern blot, Northern blot, solution hybridization, or the like, see Sambrook et al., 1989, Molecular Cloning: A Laboratory Manual, Cold Spring Harbor Laboratories, New York; or Ausubel et al. (Eds.), Current Protocols In Molecular Biology, John Wiley & Sons, Inc., New York (1997)). Such assays can be conducted using varying degrees of selectivity, for example, using conditions varying from low to high stringency. If conditions of low stringency are employed, the absence of non-specific binding can be assessed using a secondary probe that lacks even a partial degree of sequence identity (for example, a probe having less than about 30% sequence identity with the target molecule), such that, in the absence of non-specific binding events, the secondary probe will not hybridize to the target.

When utilizing a hybridization-based detection system, a nucleic acid probe is chosen that is complementary to a target nucleic acid sequence, and then by selection of appropriate conditions the probe and the target sequence "selectively hybridize," or bind, to each other to form a hybrid molecule. A nucleic acid molecule that is capable of hybridizing selectively to a target sequence under "moderately stringent" typically hybridizes under conditions that allow detection of a target nucleic acid sequence of at least about 10-14 nucleotides in length having at least approximately 70% sequence identity with the sequence of the selected nucleic acid probe. Stringent hybridization conditions typically allow detection of target nucleic acid sequences of at least about 10-14 nucleotides in length having a sequence identity of greater than about 90-95% with the sequence of the selected nucleic acid probe. Hybridization conditions useful for probe/target hybridization where the probe and target have a specific degree of sequence identity, can be determined as is known in the art (see, for example, Nucleic Acid Hybridization: A Practical Approach, editors B. D. Hames and S. J. Higgins, (1985) Oxford; Washington, D.C.; IRL Press).

With respect to stringency conditions for hybridization, it is well known in the art that numerous equivalent conditions can be employed to establish a particular stringency by varying, for example, the following factors: the length and nature of probe and target sequences, base composition of the various sequences, concentrations of salts and other hybridization solution components, the presence or absence of blocking agents in the hybridization solutions (e.g., formamide, dextran sulfate, and polyethylene glycol), hybridization reaction temperature and time parameters, as well as, varying wash conditions. The selection of a particular set of hybridization conditions is selected following standard methods in the art (see, for example, see Sambrook, et al., supra or Ausubel et al., supra).

A first polynucleotide is "derived from" second polynucleotide if it has the same or substantially the same base pair sequence as a region of the second polynucleotide, its cDNA, complements thereof, or if it displays sequence identity as described above. A first polypeptide is "derived from" a second polypeptide if it is (i) encoded by a first polynucleotide derived from a second polynucleotide, or (ii) displays sequence identity to the second polypeptides as described above.

The invention also provides a kit containing one or more vectors of the invention in a suitable vessel such as a vial. The expression vectors can contain at least one cloning site for insertion of a selected sequence of interest, or can have a specific gene of interest already present in the vector. The vector an be provided in a dehydrated or lyophilized form, or in an aqueous solution. The kit can include a buffer for reconstituting the dehydrated polynucleotide. Other reagents can be included in the kit, e.g., reaction buffers, positive and negative control vectors for comparison. Generally, the kit will also include instructions for use of the reagents therein.

Construction of IL-1 Dual-Specific Antibody: Selection of Main-Chain Conformation The members of the immunoglobulin superfamily all share a similar fold for their polypeptide chain. For example, although antibodies are highly diverse in terms of their primary sequence, comparison of sequences and crystallographic structures has revealed that, contrary to expectation, five of the six antigen binding loops of antibodies (H1, H2, L1, L2, L3) adopt a limited number of main-chain conformations, or canonical structures (Chothia and Lesk (1987) J. Mol. Biol., 196: 901; Chothia et al. (1989) Nature, 342: 877). Analysis of loop lengths and key residues has therefore enabled prediction of the main-chain conformations of H1, H2, L1, L2 and L3 found in the majority of human antibodies (Chothia et al. (1992) J. Mol. Biol., 227: 799; Tomlinson et al. (1995) EMBO J., 14: 4628; Williams et al. (1996) J. Mol. Biol., 264: 220). Although the H3 region is much more diverse in terms of sequence, length and structure (due to the use of D segments), it also forms a limited number of main-chain conformations for short loop lengths which depend on the length and the presence of particular residues, or types of residue, at key positions in the loop and the antibody framework (Martin et al. (1996) J. Mol. Biol., 263: 800; Shirai et al. (1996) FEBS Letters, 399: 1).

The dual-specific antibodies of the present invention are advantageously assembled from libraries of domains, such as libraries of $V_H$ domains and/or libraries of $V_L$ domains. Moreover, the dual-specific antibodies of the invention may themselves be provided in the form of libraries. In one aspect of the present invention, libraries of dual-specific antibodies and/or domains are designed in which certain loop lengths and key residues have been chosen to ensure that the main-chain conformation of the members is known. Advantageously, these are real conformations of immunoglobulin superfamily molecules found in nature, to minimise the chances that they are non-functional, as discussed above. Germline V gene segments serve as one suitable basic framework for constructing antibody or T-cell receptor libraries; other sequences are also of use. Variations may occur at a low frequency, such that a small number of functional members may possess an altered main-chain conformation, which does not affect its function.

Canonical structure theory is also of use to assess the number of different main-chain conformations encoded by ligands, to predict the main-chain conformation based on antibody sequences and to choose residues for diversification which do not affect the canonical structure. It is known that, in the human Vκ domain, the L1 loop can adopt one of four canonical structures, the L2 loop has a single canonical structure and that 90% of human Vκ domains adopt one of four or five canonical structures for the L3 loop (Tomlinson et al. (1995) supra); thus, in the Vκ domain alone, different canonical structures can combine to create a range of different main-chain conformations. Given that the Vλ domain encodes a different range of canonical structures for the L1, L2 and L3 loops and that Vκ and Vλ domains can pair with any VH domain which can encode several canonical structures for the H1 and H2 loops, the number of canonical structure combinations observed for these five loops is very large. This implies that the generation of diversity in the main-chain conformation may be essential for the production of a wide range of binding specificities. However, by constructing an antibody library based on a single known main-chain conformation it has been found, contrary to expectation, that diversity in the main-chain conformation is not required to generate sufficient diversity to target substantially all antigens. Even more surprisingly, the single main-chain conformation need not be a consensus structure—a single naturally occurring conformation can be used as the basis for an entire library. Thus, in a preferred aspect, the dual-specific ligands of the invention possess a single known main-chain conformation.

The single main-chain conformation that is chosen is preferably commonplace among molecules of the immunoglobulin superfamily type in question. A conformation is commonplace when a significant number of naturally occurring molecules are observed to adopt it. Accordingly, in a preferred aspect of the invention, the natural occurrence of the different main-chain conformations for each binding loop of an immunoglobulin domain are considered separately and then a naturally occurring variable domain is chosen which possesses the desired combination of main-chain conformations for the different loops. If none is available, the nearest equivalent may be chosen. It is preferable that the desired combination of main-chain conformations for the different loops is created by selecting germline gene segments which encode the desired main-chain conformations. It is more preferable, that the selected germline gene segments are frequently expressed in nature, and most preferable that they are the most frequently expressed of all natural germline gene segments.

In designing dual-specific antibodies or libraries thereof the incidence of the different main-chain conformations for each of the six antigen binding loops may be considered separately. For H1, H2, L1, L2 and L3, a given conformation that is adopted by between 20% and 100% of the antigen binding loops of naturally occurring molecules is chosen. Typically, its observed incidence is above 35% (i.e. between 35% and 100%) and, ideally, above 50% or even above 65%. Since the vast majority of H3 loops do not have canonical structures, it is preferable to select a main-chain conformation which is commonplace among those loops which do display canonical structures. For each of the loops, the conformation which is observed most often in the natural repertoire is therefore selected. In human antibodies, the most popular canonical structures (CS) for each loop are as follows: H1--CS 1 (79% of the expressed repertoire), H2--CS 3 (46%), L1--CS 2 of Vκ (39%), L2--CS 1 (100%), L3--CS 1 of Vκ (36%) (calculation assumes a κ:λ ratio of 70:30, Hood et al. (1967) Cold Spring Harbor Symp. Quant. Biol., 48: 133). For H3 loops that have canonical structures, a CDR3 length (Kabat et al. (1991) Sequences of proteins of immunological interest, U.S. Department of Health and Human Services) of seven residues with a salt-bridge from residue 94 to residue 101 appears to be the most common. There are at least 16 human antibody sequences in the EMBL data library with the required H3 length and key residues to form this conformation and at least two crystallographic structures in the protein data bank which can be used as a basis for antibody modeling (2cgr and 1tet). The most frequently expressed germline gene segments that this combination of canonical structures are the VH segment 3-23 (DP-47), the JH segment JH4b, the Vκ segment 012/02 (DPK9) and the Jκ segment Jκ1. These segments can therefore be used in combination as a basis to construct a library with the desired single main-chain conformation.

Alternatively, instead of choosing the single main-chain conformation based on the natural occurrence of the different main-chain conformations for each of the binding loops in isolation, the natural occurrence of combinations of main-chain conformations is used as the basis for choosing the single main-chain conformation. In the case of antibodies, for example, the natural occurrence of canonical structure combinations for any two, three, four, five or for all six of the antigen binding loops can be determined. Here, it is preferable that the chosen conformation is commonplace in naturally occurring antibodies and most preferable that it observed most frequently in the natural repertoire. Thus, in human antibodies, for example, when natural combinations of the five antigen binding loops, H1, H2, L1, L2 and L3, are considered, the most frequent combination of canonical structures is determined and then combined with the most popular conformation for the H3 loop, as a basis for choosing the single main-chain conformation.

Construction of IL-1 Dual-Specific Antibody: Diversification of the Canonical Sequence Having selected several known main-chain conformations or, preferably a single known main-chain conformation, dual-specific antibodies according to the invention or libraries for use in the invention may be constructed by varying the binding site of the molecule in order to generate a repertoire with structural and/or functional diversity. This means that variants are generated such that they possess sufficient diversity in their structure and/or in their function so that they are capable of providing a range of activities.

The desired diversity is typically generated by varying the selected molecule at one or more positions. The positions to be changed can be chosen at random or are preferably selected. The variation can then be achieved either by randomisation, during which the resident amino acid is replaced by any amino acid or analogue thereof, natural or synthetic, producing a very large number of variants or by replacing the resident amino acid with one or more of a defined subset of amino acids, producing a more limited number of variants.

Various methods have been reported for introducing such diversity. Error-prone PCR (Hawkins et al. (1992) J. Mol. Biol., 226: 889), chemical mutagenesis (Deng et al. (1994) J. Biol. Chem., 269: 9533) or bacterial mutator strains (Low et al. (1996) J. Mol. Biol., 260: 359) can be used to introduce random mutations into the genes that encode the molecule. Methods for mutating selected positions are also well known in the art and include the use of mismatched oligonucleotides or degenerate oligonucleotides, with or without the use of PCR. For example, several synthetic antibody libraries have been created by targeting mutations to the antigen binding loops. The H3 region of a human tetanus toxoid-binding Fab has been randomised to create a range of new binding specificities (Barbas et al. (1992) Proc. Natl. Acad. Sci. USA, 89: 4457). Random or semi-random H3 and L3 regions have been appended to germline V gene segments to produce large libraries with unmutated framework regions (Hoogenboom & Winter (1992) J. Mol. Biol., 227: 381; Barbas et al. (1992) Proc. Natl. Acad. Sci. USA, 89: 4457; Nissim et al. (1994) EMBO J., 13: 692; Griffiths et al. (1994) EMBO J., 13: 3245; De Kruif et al. (1995) J. Mol. Biol., 248: 97). Such diversification has been extended to include some or all of the other antigen binding loops (Crameri et al. (1996) Nature Med., 2: 100; Riechmann et al. (1995) Bio/Technology, 13: 475; Morphosys, WO97/08320, supra). Other methods for naïve library diversification are described in WO2005/093074 and WO2004/003019.

Since loop randomisation has the potential to create approximately more than $10^{15}$ structures for H3 alone and a similarly large number of variants for the other five loops, it is not feasible using current transformation technology or even by using cell free systems to produce a library representing all possible combinations. For example, in one of the largest libraries constructed to date, $6 \times 10^{10}$ different antibodies, which is only a fraction of the potential diversity for a library of this design, were generated (Griffiths et al. (1994) supra).

In a preferred embodiment, only those residues which are directly involved in creating or modifying the desired function of the molecule are diversified. For many molecules, the function will be to bind a target and therefore diversity should be concentrated in the target binding site, while avoiding changing residues which are crucial to the overall packing of the molecule or to maintaining the chosen main-chain conformation.

Construction of IL-1 Dual-Specific Antibody: Diversification of the Canonical Sequence as it Applies to Antibody Domains In the case of dual-specific antibodies, the binding site for the target is most often the antigen binding site. Thus, in a highly preferred aspect, the invention provides libraries of or for the assembly of dual-specific antibodies in which only those residues in the antigen binding site are varied. These residues are extremely diverse in the human antibody repertoire and are known to make contacts in high-resolution antibody/antigen complexes. For example, in L2 it is known that positions 50 and 53 are diverse in naturally occurring antibodies and are observed to make contact with the antigen. In contrast, the conventional approach would have been to diversify all the residues in the corresponding Complementarity Determining Region (CDR1) as defined by Kabat et al. (1991, supra), some seven residues compared to the two diversified in the library for use according to the invention. This represents a significant improvement in terms of the functional diversity required to create a range of antigen binding specificities.

In nature, antibody diversity is the result of two processes: somatic recombination of germline V, D and J gene segments to create a naive primary repertoire (so called germline and junctional diversity) and somatic hypermutation of the resulting rearranged V genes. Analysis of human antibody sequences has shown that diversity in the primary repertoire is focused at the centre of the antigen binding site whereas somatic hypermutation spreads diversity to regions at the periphery of the antigen binding site that are highly conserved in the primary repertoire (see Tomlinson et al. (1996) J. Mol. Biol., 256: 813). This complementarity has probably evolved as an efficient strategy for searching sequence space and, although apparently unique to antibodies, it can easily be applied to other polypeptide repertoires. The residues which are varied are a subset of those that form the binding site for the target. Different (including overlapping) subsets of residues in the target binding site are diversified at different stages during selection, if desired.

In the case of an antibody repertoire, an initial 'naive' repertoire is created where some, but not all, of the residues in the antigen binding site are diversified. As used herein in this context, the term "naive" refers to antibody molecules that have no pre-determined target. These molecules resemble those which are encoded by the immunoglobulin genes of an individual who has not undergone immune diversification, as is the case with fetal and newborn individuals, whose immune systems have not yet been challenged by a wide variety of antigenic stimuli. This repertoire is then selected against a range of antigens or epitopes. If required, further diversity can then be introduced outside the region diversified in the initial repertoire. This matured repertoire can be selected for modified function, specificity or affinity.

Two different naive repertoires of binding domains may be used for the construction of dual-specific ligands, or a naive library of dual-specific antibodies, in which some or all of the residues in the antigen binding site are varied. The "primary" library mimics the natural primary repertoire, with diversity restricted to residues at the centre of the antigen binding site that are diverse in the germline V gene segments (germline diversity) or diversified during the recombination process (junctional diversity). Those residues which are diversified include, but are not limited to, H50, H52, H52a, H53, H55, H56, H58, H95, H96, H97, H98, L50, L53, L91, L92, L93, L94 and L96. In the "somatic" library, diversity is restricted to residues that are diversified during the recombination process (junctional diversity) or are highly somatically mutated). Those residues which are diversified include, but are not limited to: H31, H33, H35, H95, H96, H97, H98, L30, L31, L32, L34 and L96. All the residues listed above as suitable for diversification in these libraries are known to make contacts in one or more antibody-antigen complexes. Since in both libraries, not all of the residues in the antigen binding site are varied, additional diversity is incorporated during selection by varying the remaining residues, if it is desired to do so. It shall be apparent to one skilled in the art that any subset of any of these residues (or additional residues which comprise the antigen binding site) can be used for the initial and/or subsequent diversification of the antigen binding site.

In the construction of libraries for use in the invention, diversification of chosen positions is typically achieved at the nucleic acid level, by altering the coding sequence which specifies the sequence of the polypeptide such that a number of possible amino acids (all 20 or a subset thereof) can be incorporated at that position. Using the IUPAC nomenclature, the most versatile codon is NNK, which encodes all amino acids as well as the TAG stop codon. The NNK codon is preferably used in order to introduce the required diversity. Other codons which achieve the same ends are also of use, including the NNN codon, which leads to the production of the additional stop codons TGA and TAA.

A feature of side-chain diversity in the antigen binding site of human antibodies is a pronounced bias which favors certain amino acid residues. If the amino acid composition of the ten most diverse positions in each of the $V_H$, Vκ and Vλ regions are summed, more than 76% of the side-chain diversity comes from only seven different residues, these being, serine (24%), tyrosine (14%), asparagine (11%), glycine (9%), alanine (7%), aspartate (6%) and threonine (6%). This bias towards hydrophilic residues and small residues which can provide main-chain flexibility probably reflects the evolution of surfaces which are predisposed to binding a wide range of antigens or epitopes and may help to explain the required promiscuity of antibodies in the primary repertoire.

Since it is preferable to mimic this distribution of amino acids, the distribution of amino acids at the positions to be varied preferably mimics that seen in the antigen binding site of antibodies. Such bias in the substitution of amino acids that permits selection of certain polypeptides (not just antibody polypeptides) against a range of target antigens is easily applied to any polypeptide repertoire. There are various methods for biasing the amino acid distribution at the position to be varied (including the use of tri-nucleotide mutagenesis, see WO97/08320), of which the preferred method, due to ease of synthesis, is the use of conventional degenerate codons. By comparing the amino acid profile encoded by all combinations of degenerate codons (with single, double, triple and quadruple degeneracy in equal ratios at each position) with the natural amino acid use it is possible to calculate the most representative codon. The codons (AGT)(AGC)T, (AGT) (AGC)C and (AGT)(AGC)(CT)—that is, DVT, DVC and DVY, respectively using IUPAC nomenclature—are those closest to the desired amino acid profile: they encode 22% serine and 11% tyrosine, asparagine, glycine, alanine, aspartate, threonine and cysteine. Preferably, therefore, libraries are constructed using either the DVT, DVC or DVY codon at each of the diversified positions.

Domains identified from library screening are then subjected to mutagenesis and further screened in order to produce and select variants with improved characteristics.

IV. Uses of IL-1 Dual-Specific Antibody

Given their ability to bind to both IL-1α and IL-1β, the dual-specific antibodies, or portions thereof (including single domain antibodies identified in the process of making the dual-specific antibodies), of the invention can be used to detect IL-1α and/or IL-1β (e.g., in a biological sample, such as serum or plasma), using a conventional immunoassay, such as an enzyme linked immunosorbent assays (ELISA), an radioimmunoassay (RIA) or tissue immunohistochemistry. The invention provides a method for detecting IL-1α and/or IL-1β in a biological sample comprising contacting a biological sample with an antibody, or antibody portion, of the invention and detecting either the antibody (or antibody portion) bound to IL-1α and/or IL-1β or unbound antibody (or antibody portion), to thereby detect IL-1α and/or IL-1β in the biological sample. The antibody is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of suitable radioactive material include 125I, 131I, 35S or 3H.

Alternative to labeling the antibody, IL-1α and/or IL-1β can be assayed in biological fluids by a competition immunoassay utilizing IL-1α and/or IL-1β standards labeled with a detectable substance and an unlabeled anti-IL-1α and/or anti-IL-1β antibody. In this assay, the biological sample, the labeled IL-1α and/or IL-1β standards and the anti-IL-1α and/or anti-IL-1β antibody are combined and the amount of labeled IL-1α and/or IL-1β standard bound to the unlabeled antibody is determined. The amount of IL-1α and/or IL-1β in the biological sample is inversely proportional to the amount of labeled IL-1α and/or IL-1β standard bound to the anti-IL-1α and/or anti-IL-1β antibody.

The dual-specific antibodies and antibody portions of the invention are capable of neutralizing IL-1α and IL-1β activity. Accordingly, the antibodies and antibody portions of the invention can be used to inhibit IL-1α and/or IL-1β activity, e.g., in a cell culture containing IL-1α and/or IL-1β, in human subjects. In one embodiment, the invention provides a method for inhibiting IL-1α and IL-1β activity comprising contacting IL-1α and IL-1β with an antibody or antibody portion of the invention such that IL-1α and IL-1β activity is inhibited. Preferably, the IL-1α and hIL-1β is human IL-1α and IL-1β. For example, in a cell culture containing, or suspected of containing hIL-1α and hIL-1β, an antibody or antibody portion of the invention can be added to the culture medium to inhibit hIL-1α and hIL-1β activity in the culture.

In another embodiment, the invention provides a method for inhibiting IL-1α and IL-1β activity in a subject suffering from a disorder in which that IL-1α and IL-1β activity is detrimental. The invention provides methods for inhibiting IL-1α and IL-1β activity in a subject suffering from such a disorder, which method comprises administering to the subject a dual-specificity antibody or antibody portion of the invention such that IL-1α and IL-1β activity in the subject is inhibited. Preferably, the IL-1α and IL-1β is human IL-1α and IL-1β and the subject is a human subject. An antibody of the invention can be administered to a human subject for therapeutic purposes. Moreover, an antibody of the invention can be administered to a non-human mammal expressing IL-1α and IL-1β with which the antibody binds for veterinary purposes or as an animal model of human disease. Regarding the latter, such animal models may be useful for evaluating the therapeutic efficacy of antibodies of the invention (e.g., testing of dosages and time courses of administration).

As used herein, the phrase "a disorder in which IL-1 activity is detrimental" or the phrase "a disorder in which IL-1α and IL-1β is detrimental," is intended to include diseases and other disorders in which the presence of IL-1 (which encompasses both IL-1α and IL-1β) in a subject suffering from the disorder has been shown to be or is suspected of being either responsible for the pathophysiology of the disorder or a factor that contributes to a worsening of the disorder. Accordingly, a disorder in which IL-1 activity is detrimental is a disorder in which inhibition of IL-1 activity (i.e., either or both of IL-1α and IL-1β) is expected to alleviate the symptoms and/or progression of the disorder. Such disorders may be evidenced, for example, by an increase in the concentration of IL-1 in a biological fluid of a subject suffering from the disorder (e.g., an increase in the concentration of IL-1 in serum, plasma, synovial fluid, etc. of the subject), which can be detected, for example, using an anti-IL-1 antibody as described above.

Interleukin 1 plays a critical role in the pathology associated with a variety of diseases involving immune and inflammatory elements. These diseases include, but are not limited to, rheumatoid arthritis, osteoarthritis, juvenile chronic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia greata, seronegative arthopathy, arthropathy, Reiter's disease, psoriatic arthropathy, ulcerative colitic arthropathy, enteropathic synovitis, chlamydia, *yersinia* and *salmonella* associated arthropathy, spondyloarthopathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjogren's disease associated lung disease, ankylosing spondylitis associated lung disease, vasculitic diffuse lung disease, haemosiderosis associated lung disease, drug-induced interstitial lung disease, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasulitis of the kidneys, lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjorgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo, diseases of the central nervous system (e.g., depression, schizophrenia, Alzheimers, Parkinsons, etc.), acute and chronic pain, and lipid imbalance. The human antibodies, and antibody portions of the invention can be used to treat humans suffering from autoimmune diseases, in particular those associated with inflammation, including, rheumatoid spondylitis, allergy, autoimmune diabetes, or autoimmune uveitis.

Preferably, the IL-1α and IL-1β dual-specific antibodies of the invention or antigen-binding portions thereof, are used to treat rheumatoid arthritis, Crohn's disease, multiple sclerosis, insulin dependent diabetes, mellitus and psoriasis.

An IL-1α and IL-1β dual-specific antibody, or antibody portion, of the invention also can be administered with one or more additional therapeutic agents useful in the treatment of autoimmune and inflammatory diseases.

It is understood that all of the above-mentioned IL1-related disorders include both the adult and juvenile forms of the disease where appropriate. It is also understood that all of the above-mentioned disorders include both chronic and acute forms of the disease.

Antibodies of the invention, or antigen binding portions thereof may be used alone or in combination to treat such diseases. It should be understood that the antibodies of the invention or antigen binding portion thereof can be used alone or in combination with an additional agent, e.g., a therapeutic agent, said additional agent being selected by the skilled artisan for its intended purpose. For example, the additional agent can be a therapeutic agent art-recognized as being useful to treat the disease or condition being treated by the antibody of the present invention. The additional agent also can be an agent which imparts a beneficial attribute to the therapeutic composition e.g., an agent which effects the viscosity of the composition.

It should further be understood that the combinations which are to be included within this invention are those combinations useful for their intended purpose. The agents set forth below are illustrative for purposes and not intended to be limited. The combinations which are part of this invention can be the antibodies of the present invention and at least one additional agent selected from the lists below. The combination can also include more than one additional agent, e.g., two or three additional agents if the combination is such that the formed composition can perform its intended function.

Preferred combinations are non-steroidal anti-inflammatory drug(s) also referred to as NSAIDS which include drugs like ibuprofen and COX-2 inhibitors. Other preferred combinations are corticosteroids including prednisolone; the well known side-effects of steroid use can be reduced or even eliminated by tapering the steroid dose required when treating patients in combination with the anti-IL-1 antibodies of this invention. Non-limiting examples of therapeutic agents for rheumatoid arthritis with which an antibody, or antibody portion, of the invention can be combined include the following: cytokine suppressive anti-inflammatory drug(s) (CSAIDs); antibodies to or antagonists of other human cytokines or growth factors, for example, TNF, LT, IL-2, IL-6, IL-7, IL-8, IL-12, IL-15, IL-16, IL-18, EMAP-II, GM-CSF, FGF, and PDGF. Antibodies of the invention, or antigen binding portions thereof, can be combined with antibodies to cell surface molecules such as CD2, CD3, CD4, CD8, CD25, CD28, CD30, CD40, CD45, CD69, CD80 (B7.1), CD86 (B7.2), CD90, or their ligands including CD154 (gp39 or CD40L).

Preferred combinations of therapeutic agents may interfere at different points in the autoimmune and subsequent inflammatory cascade; preferred examples include TNF antagonists like chimeric, humanized or human TNF antibodies, D2E7 (adalimumab; PCT Publication No. WO 97/29131), CA2 (Remicade™), CDP 571, CDP 870, Thalidamide and soluble p55 or p75 TNF receptors, derivatives, thereof, (p75TNFR1gG (Enbrel™) or p55TNFR1gG (Lenercept), and also TNFα converting enzyme (TACE) inhibitors; similarly IL-1 inhibitors (Interleukin-1-converting enzyme inhibitors, IL-1RA etc.) may be effective for the same reason. Other preferred combinations include Interleukin 11. Yet another preferred combination are other key players of the autoimmune response which may act parallel to, dependent on or in concert with IL-1 function; especially preferred are IL-12 and/or IL-18 antagonists including IL-12 and/or IL-18 antibodies or soluble IL-12 and/or IL-18 receptors, or IL-12 and/or IL-18 binding proteins. It has been shown that IL-12 and IL-18 have overlapping but distinct functions and a combination of antagonists to both may be most effective. Yet another preferred combination are non-depleting anti-CD4 inhibitors. Yet other preferred combinations include antagonists of the co-stimulatory pathway CD80 (B7.1) or CD86 (B7.2) including antibodies, soluble receptors or antagonistic ligands.

The antibodies of the invention, or antigen binding portions thereof, may also be combined with agents, such as methotrexate, 6-MP, azathioprine sulphasalazine, mesalazine, olsalazine chloroquinine/hydroxychloroquine, pencillamine, aurothiomalate (intramuscular and oral), azathioprine, cochicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signaling by proinflammatory cytokines such as TNFα or IL-1 (e.g. IRAK, NIK, IKK, p38 or MAP kinase inhibitors), IL-1β converting enzyme inhibitors, TNFα converting enzyme (TACE) inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g. soluble p55 or p75 TNF receptors and the derivatives p75TNFRIgG (Enbrel™ and p55TNFRIgG (Lenercept)), sIL-1RI, sIL-1RII, sIL-6R) and antiinflammatory cytokines (e.g. IL-4, IL-10, IL-11, IL-13 and TGF β). Preferred combinations include methotrexate or leflunomide and in moderate or severe rheumatoid arthritis cases, cyclosporine.

Non-limiting examples of therapeutic agents for inflammatory bowel disease with which an antibody, or antibody portion, of the invention can be combined include the following: budenoside; epidermal growth factor; corticosteroids; cyclosporin, sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β monoclonal antibodies; anti-IL-6 monoclonal antibodies; growth factors; elastase inhibitors; pyridinyl-imidazole compounds; antibodies to or antagonists of other human cytokines or growth factors, for example, TNF, LT, IL-2, IL-6, IL-7, IL-8, IL-12, IL-15, IL-16, IL-18, EMAP-II, GM-CSF, FGF, and PDGF. Antibodies of the invention can be combined with antibodies to cell surface molecules such as CD2, CD3, CD4, CD8, CD25, CD28, CD30, CD40, CD45, CD69, CD90 or their ligands. The antibodies of the invention, or antigen binding portions thereof, may also be combined with agents, such as methotrexate, cyclosporin, FK506, rapamycin, mycophenolate mofetil, leflunomide, NSAIDs, for example, ibuprofen, corticosteroids such as prednisolone, phosphodiesterase inhibitors, adenosine agonists, antithrombotic agents, complement inhibitors, adrenergic agents, agents which interfere with signalling by proinflammatory cytokines such as TNFα or IL-1 (e.g. IRAK, NIK, IKK, p38 or MAP kinase inhibitors), IL-1β converting enzyme inhibitors, TNFβ converting enzyme inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g. soluble p55 or p75 TNF receptors, sIL-1RI, sIL-1RII, sIL-6R) and antiinflammatory cytokines (e.g. IL4, IL-10, IL-11, IL-13 and TGFβ).

Preferred examples of therapeutic agents for Crohn's disease in which an antibody or an antigen binding portion can be combined include the following: TNF antagonists, for example, anti-TNF antibodies, D2E7 (adalimumab; PCT Publication No. WO 97/29131), CA2 (Remicade™), CDP 571, TNFR-Ig constructs, (p75TNFRIgG (Enbrel™) and p55TNFRIgG (Lenercept)) inhibitors and PDE4 inhibitors. Antibodies, or antigen binding portions thereof, of the invention or antigen binding portions thereof, can be combined with corticosteroids, for example, budenoside and dexamethasone, Antibodies of the invention or antigen binding portions thereof, may also be combined with agents such as sulfasalazine, 5-aminosalicylic acid and olsalazine, and agents which interfere with synthesis or action of proinflammatory cytokines such as IL-1, for example, IL-1β converting enzyme inhibitors and IL-1ra. Antibodies of the invention or antigen binding portion thereof may also be used with T cell signaling inhibitors, for example, tyrosine kinase inhibitors 6-mercaptopurines. Antibodies of the invention or antigen binding portions thereof, can be combined with IL-11.

Non-limiting examples of therapeutic agents for multiple sclerosis with which an antibody, or antibody portion, of the invention can be combined include the following: corticosteroids; prednisolone; methylprednisolone; azathioprine; cyclophosphamide; cyclosporine; methotrexate; 4-aminopyridine; tizanidine; interferon-β1a (Avonex; Biogen); interferon-β1b (Betaseron; Chiron/Berlex); Copolymer 1 (Cop-1; Copaxone; Teva Pharmaceutical Industries, Inc.); hyperbaric oxygen; intravenous immunoglobulin; clabribine; antibodies to or antagonists of other human cytokines or growth factors, for example, TNF, LT, IL-2, IL-6, IL-7, IL-8, IL-12, IL-15, IL-16, IL-18, EMAP-II, GM-CSF, FGF, and PDGF. Antibodies of the invention, or antigen binding portions thereof, can be combined with antibodies to cell surface molecules such as CD2, CD3, CD4, CD8, CD25, CD28, CD30, CD40, CD45, CD69, CD80, CD86, CD90 or their ligands. The antibodies of the invention, or antigen binding portions thereof, may also be combined with agents, such as methotrexate, cyclosporine, FK506, rapamycin, mycophenolate mofetil, leflunomide, NSAIDs, for example, ibuprofen, COX-2 inhibitors, corticosteroids such as prednisolone, phosphodiesterase inhibitors, adensosine agonists, antithrombotic agents, complement inhibitors, adrenergic agents, agents which interfere with signalling by proinflammatory cytokines such as TNFα or IL-1 (e.g. IRAK, NIK, IKK, p38 or MAP kinase inhibitors), IL-1β converting enzyme inhibitors, TACE inhibitors, T-cell signalling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g. soluble p55 or p75 TNF receptors, sIL-1RI, sIL-1RII, sIL-6R) and antiinflammatory cytokines (e.g. IL4, IL-10, IL-13 and TGFβ).

Preferred examples of therapeutic agents for multiple sclerosis in which the antibody or antigen binding portion thereof can be combined to include interferon-β, for example, IFNβ1a and IFNβ1b; copaxone, corticosteroids, IL-1 inhibitors, TNF inhibitors, and antibodies to CD40 ligand and CD80.

IV. Pharmaceutical Compositions and Pharmaceutical Administration

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions, such as compositions similar to those used for passive immunization of humans with other antibodies. The preferred mode of administration is parenteral (e.g., intravenous, subcutaneous, intraperitoneal, intramuscular). In a preferred embodiment, the antibody is administered by intravenous infusion or injection. In another preferred embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile, lyophilized powders for the preparation of sterile injectable solutions, the preferred methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The antibodies and antibody-portions of the present invention can be administered by a variety of methods known in the art, although for many therapeutic applications, the preferred route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

In certain embodiments, an antibody or antibody portion of the invention may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound of the invention by other than parenteral administration, it may be necessary to coat the compound with, or co-administer the compound with, a material to prevent its inactivation.

Supplementary active compounds can also be incorporated into the compositions. In certain embodiments, an antibody or antibody portion of the invention is coformulated with and/or coadministered with one or more additional therapeutic agents that are useful for treating disorders in which IL-1 activity is detrimental. For example, an anti-hIL-1 antibody or antibody portion of the invention may be coformulated and/or coadministered with one or more additional antibodies that bind other targets (e.g., antibodies that bind other cytokines or that bind cell surface molecules). Furthermore, one or more antibodies of the invention may be used in combination with two or more of the foregoing therapeutic agents. Such combination therapies may advantageously utilize lower dosages of the administered therapeutic agents, thus avoiding possible toxicities or complications associated with the various monotherapies. It will be appreciated by the skilled practitioner that when the antibodies of the invention are used as part of a combination therapy, a lower dosage of antibody may be desirable than when the antibody alone is administered to a subject (e.g., a synergistic therapeutic effect may be achieved through the use of combination therapy which, in turn, permits use of a lower dose of the antibody to achieve the desired therapeutic effect).

The pharmaceutical compositions of the invention may include a "therapeutically effective amount" or a "prophylactically effective amount" of an antibody or antibody portion of the invention. A "therapeutically effective amount" refers to an amount effective, at dosages and for periods of time necessary, to achieve the desired therapeutic result. A therapeutically effective amount of the antibody or antibody portion may vary according to factors such as the disease state, age, sex, and weight of the individual, and the ability of the antibody or antibody portion to elicit a desired response in the individual. A therapeutically effective amount is also one in which any toxic or detrimental effects of the antibody or antibody portion are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

An exemplary, non-limiting range for a therapeutically or prophylactically effective amount of an antibody or antibody portion of the invention is 0.1-20 mg/kg, more preferably 1-10 mg/kg. It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

The contents of all references, patents and published patent applications cited throughout this application are incorporated herein by reference This invention is further illustrated by the following examples which should not be construed as limiting.

EXAMPLES

The following examples describes methods and compositions for making a dual-specific antibody which is specific for and can neutralize both IL-1α and IL-1β. The following examples detail how to select IL-1α and IL-1β domain antibodies (dAbs), how to affinity mature the identified dAbs to improve desired characteristics (affinity and neutralization properties), and how to construct a dual-specific antibody which retains the affinity and neutralization properties of the parent antibody.

For each clone described herein, the first part of the name relates to its specificity (IL-1α represented by ABT1; and IL-1β represented by ABT2), followed by the first number which relates to the lineage from which that clone is derived and a second number which is the unique identifier for that clone.

Example 1

Selection of IL-1α and IL-1β Domain Antibodies

Human phage antibody libraries containing either variable heavy or variable light single human frameworks were used in the screen to identify specific IL-1α and IL-1β domain antibodies (dAbs).

The dAb libraries used in the screen were based on the DP47 or DPk9 germline sequences, i.e., a single human framework for VH (V3-23 [locus] DP47 [V Base Entry] and JH4b) and $V_L$ (012/02 [locus] DPκ9 [V Base Entry] and Jκ1) with side chain diversity incorporated at positions in the antigen binding site that make contacts with antigen in known molecular structures. Importantly, these positions are also highly diverse in the mature repertoire. The canonical structure (VH: 1-3, VL: 2-1-1) encoded by these frameworks are the most common in the human antibody repertoire. The CDR3 of the heavy chain was designed to be as short as possible yet still able to form an antigen binding surface. The libraries were selected and affinity matured without knowing the sequence of selected clones.

The library format used was dAb displayed on phage (single or multiple copies of a human variable VH or Vκ domain displayed on a phage virus particle as gene III fusions). The VH library size was $1.6 \times 10^{10}$ and the Vκ library size was $1.7 \times 10^{10}$. The libraries were phage libraries; therefore all the genes required to generate functional phage plus the geneIII-dab gene fusion were encoded on the phage vector (pDOM4 vector).

Three selection rounds were performed with clones screened from the outputs of selections rounds 2 and 3. Selection type was in solution using biotinylated antigen. Increase in phage output titre was used as an indication of specific phage enrichment during the selection rounds. Monoclonal phage were tested at rounds 2 and 3 for binding to antigen coated or captured by ELISA prior to screening the soluble dAb from these selection outputs. There were no antibody positive controls used during initial screening; however MAb200 and MAb201 were used as positive inhibiting IgG in the functional cell assay. Each single domain antibody was chosen by binding of a phage repertoire to the antigen, i.e., either human IL-1α or human IL-1β. Variable heavy and variable light dAbs to both IL-1α and IL-1β were identified.

DNA purification was by QIAprep Spin Miniprep Kit; QIAfilter Plasmid Midi Kit or QIAfilter Plasmid Maxi Kit as appropriate for the amount of DNA required (kits by QIAGEN Ltd., QIAGEN House, Fleming Way, Crawley, West Sussex, RH10 9NQ), using the standard protocols supplied with the kits.

Sequences of the single domain antibodies (dAbs) identified in the screen are described in Table 60.

Example 2

Affinity maturation of IL-1α/IL-1β Domain Antibodies (dAbs)

Affinity maturation of the dAbs identified in the library screen described in Example 1 was performed using different affinity maturation processes, as described below.

21.1. Emulsion Affinity Maturation of IL-1α Dab ABT1-95 Overview. One of the domain antibodies identified in the library screen, i.e., ABT1-95, was affinity matured by Emulsion selection, improving neutralization from an $ND_{50}$ of 1 µM to an $ND_{50}$ of 50 pM for ABT1-95-15. This process of affinity maturation was done in three incremental stages. In the first stage, two ABT1-95 derived clones were isolated: ABT1-95-1 and ABT1-95-2. By recombining these two mutants the clone ABT1-95-3 was created and was determined to have an $ND_{50}$ of 50 nM. Four libraries, each mutating four positions at a time with NNS diversification (wherein N=nucleotides A/T/C/G and S=nucleotides G or C) targeting either CDR1 (2×), CDR2/3, and CDR3 were created from ABT1-95-3. In addition to these libraries an error prone library was made. After selection in emulsions nine clones were identified with improved binding and $ND_{50}$ values of about 1 nM. Analysis of the best clones identified positions 30, 31, 55, and 56 as being highly relevant for high affinity binding. Selections from an NNS library specifically targeting these positions yielded three clones with $ND_{50}$'s in the 50-250 pM range: ABT1-95-13, ABT1-95-14 and ABT1-95-15.

Detailed Description of Isolation Process for ABT1-95-15

Two ABT1-95 derived dAbs (Y88H named ABT1-95-1 (which contained a Y88H mutation), and a mutant that contained the same CDR2 as ABT1-141 named ABT1-95-2) were isolated from an ABT1-122 library selection. As shown in the table below, both clones had moderate increases in affinity over the parental ABT1-95. However, when these changes were combined by site directed mutagenesis, the new clone, ABT1-95-3, showed a marked increase in affinity (7-12 nM). Below are the BIAcore kinetics using an IL-1α coated chip with purified dAb flowed over the surface.

TABLE 1

| BIAcore kinetics summary | | | |
|---|---|---|---|
| | kon | koff | Kd (nM) |
| ABT1-122 | 2.9-6.2 × $10e^5$ | 0.025 | 40-86 |
| ABT1-95-1 | 3.6-6.6 × $10e^5$ | 0.013-0.015 | 20-42 |
| ABT1-95-2 | 2.3-2.4 × $10e^5$ | 7.6-9.6 × 10e-3 | 32-42 |
| ABT1-95-3 | 4.7-6.4 × $10e^5$ | 4.7-5.7 × 10e-3 | 7-12 |

To create new affinity maturation libraries based on ABT1-95-3, new 'signature' templates were constructed. These templates contained unique restriction sites, which would no longer be present once libraries were constructed on the basis of these templates. This made it possible to remove selectively parental clones from the selection by restriction digest and focus on library-derived dAbs.

Four signature templates were constructed and verified by sequencing:
1) ABT1-95-3*: −BtsI+BamHI
2) ABT1-95-2*: −BtsI+BamHI
3) ABT1-95-3*-k1: −BtsI+BamHI+KpnI after CDR1
4) ABT1-95-3*-k3: −BtsI+BamHI+KpnI after CDR3

These constructs were then used for construction of six libraries.

1) CDR1-1: Pro Ile NNS NNS NNS Leu NNS with template ABT1-95-3*-k1 ("Pro Ile NNS NNS NNS Leu NNS" disclosed as SEQ ID NO: 1159)
2) CDR1-2: NNS NNS Ile His NNS NNS Leu Arg with template ABT1-95-3*-k1 ("NNS NNS Ile His NNS NNS Leu Arg" disclosed as SEQ ID NO: 1160)
3) CDR2/3: NNS Ser Ser Ser NNS . . . NNS Tyr Arg Trp Pro NNS: with template ABT1-95-3*-k3 ("NNS Ser Ser Ser NNS" disclosed as SEQ ID NO: 1161 and "NNS Tyr Arg Trp Pro NNS" disclosed as 1162)
4) 88+CDR3: NNS Cys NNS Gln NNS Tyr NNS Trp Pro Val with template ABT1-95-3*-k3 ("NNS Cys NNS Gln NNS Tyr NNS Trp Pro Val" SEQ ID NO: 1163)
5) Error-prone 1 with template ABT1-95-2*
6) Error-prone 2 with template ABT1-95-3*

Diversity for libraries numbered 1-4 was complete, while for the error-prone libraries diversity exceeded $1×10^8$, which is higher than the diversity that can be assessed with emulsion. Error rates were about 2.5 nucleotide mutations per dAb. This was at the low end, but additional mutagenesis can be performed after e.g. 3 rounds of selection.

The six ABT1-95-3 libraries were subjected to nine rounds of emulsion selection. Libraries 1, 2, 3 and 4 went through 3 rounds of selection at relatively high IL-1α concentrations (50, 20, 10 nM), were then mixed 1:1:1:1, and subjected to 6 rounds of off-rate selection. During off-rate selection cold IL-1α concentration was increased from 300 to 1000 nM, while 'hot' IL-1a was kept at 10 nM. All off-rate selections were performed for short periods of time (i.e. 5-20 min.) and in the presence of free Ter operator (3 nM, 2000-fold excess) to limit rebinding of Tus-dAb complexes to non-corresponding DNA. Library 4 was also treated separately, and went through 7 rounds of selection using the same conditions as above. For the error-prone libraries, after each three rounds of selection an error-prone amplification step was introduced (using the GenemorphII mutagenesis kit). Error-prone libraries that had gone through both two and three rounds of mutagenesis were selected up to the ninth round. For additional details on emulsions using the TUS DNA-binding protein, see WO 06/046042A2, incorporated by reference herein, which describes the sequences of all oligonucleotides and vectors used herein.

After nine rounds, all dAbs were cloned into both pDOM-5 and Tus vectors and screening of individual clones has been initiated.

A total of 177 colonies isolated after nine round of selection (using Tus) on IL-1α were analysed: 72 colonies expressed dAbs (in pDOM5) with strong signals in ELISA on IL-1α. Following BIAcore analysis for off-rates, 33 dAbs showed a decreased off-rate when compared to ABT1-95-3: by sequencing, it was shown that the vast majority of these clones had unique sequences with mutations targeting primarily H30 and Q55. Further detailed analysis of 8 clones revealed Kd between 0.8 and 2.9 nM (Kd ABT1-95-3 is 5.4 nM) and ND50 values between 0.3 nM and 1 nM. ABT1 cell assay (100 pg/ml IL-1α) results are described in Table 62.

Further off-rate selections (3 rounds) with the pooled libraries did not yield improved clones: all the selected clones were identical to those already isolated at round 9 (ABT1-95-10 and ABT1-95-8).

Repeated prepping followed by cell assay reconfirmed that all ABT-95-3 derived variants (i.e. 954 through -12) had increased affinity for IL-1α. However, further affinity improvements were needed. Therefore, a next generation of affinity maturation was begun using ABT1-95-4, -8 and -12 as templates. Error-prone libraries were made of all three, while of ABT1-95-4 also a NNS library at positions 30, 31, 55, 56 was made. The latter was made by 3 fragment SOE because the distance between positions was too large to make a single oligonucleotide. All libraries were verified by sequencing, with the error-prone libraries having an average of 2.4 bp mutations/dAb. The NNS library was checked for parent by digestion with FspI, which demonstrated no visible parent on gel. In a first run, 6 rounds of selection were performed as noted below, the first value for NNS library, the second for the ep library.

round 1 20 nM, 10 nM
round 2 10 nM+4/10 min, 500 nM cold
round 3 10 nM+20/30 min, 750 nM cold
round 4 10 nM+60/75 min, 1600 nM cold Output at this stage was digested with BtsI to remove a known contaminant. The NNS library was kept separate while the error-prone libraries were pooled.

round 5n 10 nM+60 min 750 nM cold
round 6n 10 nM+75 min 1 uM cold
round 7* 10 nM+105 min 1 uM cold
round 8* 10 nM+105 min 1 uM cold
round 9 10 nM+105 min 1 uM cold This time the yield of recovery of the dAb PCR was better and maintained above 400 ng/well. Round 9 was recloned in pDOM5, transformed to MACH1 cells, and 96 supernatants were screened on BIAcore for off-rate. Only a small percentage (10%) of clones were inactive, 15% had off-rates significantly faster than parent, while 75% had off-rates of at least parent. A subset of clones didn't regenerate well, potentially indicating tighter binding. A total of 34 clones were taken further for purification and detailed analysis. Sequence analysis indicated clones to be diverse but focussed. Of these, 28 purified well and went into RBA (Receptor Binding Assay described below).

IL-1 Receptor Binding Assay. The majority was at least as good as ABT1-95-8 (1 nM), while 7 clones were better. These seven were tested in the cell assay and 6 out of 7 were better than 95-8. Summary of characterization is shown in Table 2 below. BIAcore was also performed on purified clones, but values were not very reliable, especially since the Koff values tend to be influenced by drift of the baseline.

TABLE 2

After round 9, pools were cloned in pDOM5 and screened

| | NNS | ep | Total |
|---|---|---|---|
| Colonies picked BIAcore screen | 48 | 45 | 93 |
| Inactive | 5 | 3 | 8 (9%) |
| faster off | 14 | 5 | 19 (20%) |
| off ≦ 95-8 | 29 | 37 | 66 (71%) |
| Purified | 18 | 16 | 34 |

TABLE 2-continued

| | |
|---|---|
| RBA | 7/28 better than 95-8 |
| MRC5 | 6/7 better than 95-8 |

Sequences, MRC5 data, and BIAcore for three best clones

| | | ND50 | kon | koff | KD |
|---|---|---|---|---|---|
| ABT1-95-13 | VR, ER (30, 31, 55, 56) | 120 pM | 2.00E+06 | 1.90E−03 | 9.50E−10 |
| ABT1-95-14 | VK, ER | 250 pM | 1.60E+06 | 1.90E−03 | 1.20E−09 |
| ABT1-95-15 | VR, EP | 45 pM | 2.00E+06 | 1.30E−03 | 6.70E−10 |

Detailed Description on how Emulsions Described Above were Performed

Library construction. Error-prone libraries: one pg of template DNA was PCR amplified using GenemorphII for 35 cycles with the primer set OA16/17n, followed by a restriction digest with SalI and NotI. The clean fragments were ligated in the vector pIE7t$^3$T using T4 DNA ligase. Small aliquots of the ligation product were amplified in the presence of competitor DNA to establish that the number of ligation events exceeded $10^9$. The libraries were PCR amplified from the ligation reaction using Platinum pfx and primers AS12/18 (Tus libraries). For targeted diversification libraries, oligonucleotides containing NNS codons at the indicated positions were used and the dAb was assembled by overlap PCR. The assembly reaction was PCR amplified with OA16/17n oligonucleotides using PfuUltra DNA polymerase and cloned SalI/NotI in the respective IVT vector.

In vitro expression and emulsification. For in vitro transcription/translation of the library of PCR fragments the following reaction mixture was used: 1.5 μl 100 mM oxidized glutathione, 2 μl 5 mM Methionine, 0.5 μl DNA ($5.0\times10^8$ molecules), 10 μl $H_2O$, biotinylated antigen at varying concentrations, and 35 μl of EcoPro T7 (Novagen) coupled transcription-translation extract. Immediately after mixing, the extract was added to 0.7 ml of light white mineral oil containing 4.5% (v/v) Span-80 and 0.5% (v/v) Triton X-100. Emulsification was carried out by spinning a magnetic stirrer for 5 min at 2000 rpm in a 5 ml glass vial. Microscopic analysis of droplet formation confirmed that droplets were ~2 μm in diameter. The emulsion was incubated for 60 min at 25° C. to allow expression and formation of the protein-DNA complex to take place. Breaking of the emulsion was performed by adding 0.25 ml of PBS/1% BSA/biotinylated antigen and 0.5 ml hexane/20% (v/v) mineral oil, followed by brief vortex and centrifugation for 1 min at 13 k rpm. After removal of the oil phase, 1 ml of hexane/mineral oil was added and the procedure repeated three times. The last extraction was performed using only hexane.

Selection and amplification. Selection for binders was performed by incubating the extracted aqueous phase for 30 min in the presence 50-5 nM of biotinylated antigen (See previous information for exact conditions used per round). If off-rate selections were performed, this incubation was followed by addition of an excess of unbiotinylated antigen and incubation in the 5-105 min range. Each emulsion reaction was then divided over 5 wells of a streptavidin coated PCR plate (50 μl well), incubated for 15 min at 25° C., and washed 4 times with PBS/BSA. Fifty μl of PCR mix containing either OA16/17n primers, PfuUltra buffer, dNTPs, 2.5 u PfuUltra DNA polymerase was added to each well. PCR was performed for 30 cycles. For Tus selections, the PCR product was cleaned and digested with SalI/NotI. The fragment was then ligated in pIE7t$^3$T vector and amplified as described in library construction.

For additional details on emulsions using the TUS DNA-binding protein, see WO 06/046042A2, incorporated by reference herein, which describes the sequences of all oligonucleotides and vectors used.

Further Affinity Maturation of ABT-1-95-15

ABT1-95 was affinity matured by Emulsion selection from an $ND_{50}$ of 1 μM to an $ND_{50}$ of 50 pM for ABT1-95-15. This was done in three incremental stages, as described above. Generally, in the first stage, two ABT1-95 derived clones were isolated: ABT1-95-1 and ABT1-95-2. By recombining these two mutants the clone ABT1-95-3 was created and was determined to have an $ND_{50}$ of 50 nM.

Four libraries, each mutating four positions at a time with NNS (wherein N is nucleotide A, T, C, or G and S is a nucleotide G, or C) diversification targeting either CDR1 (2×), CDR2/3, and CDR3 were created from ABT1-95-3. In addition to these libraries an error prone library was made. After selection in emulsions nine clones were identified with improved binding and $ND_{50}$ values of about 1 nM. Analysis of the best clones identified positions 30, 31, 55, and 56 as being highly relevant for high affinity binding. Selections from an NNS library specifically targeting these positions yielded three clones with $ND_{50}$'s in the 50-250 pM range: ABT1-95-13, ABT1-95-15 and ABT1-95-15. ABT1-95-15 was then further matured using the parallel strategies of NNS screening and yeast display.

Figure 21:
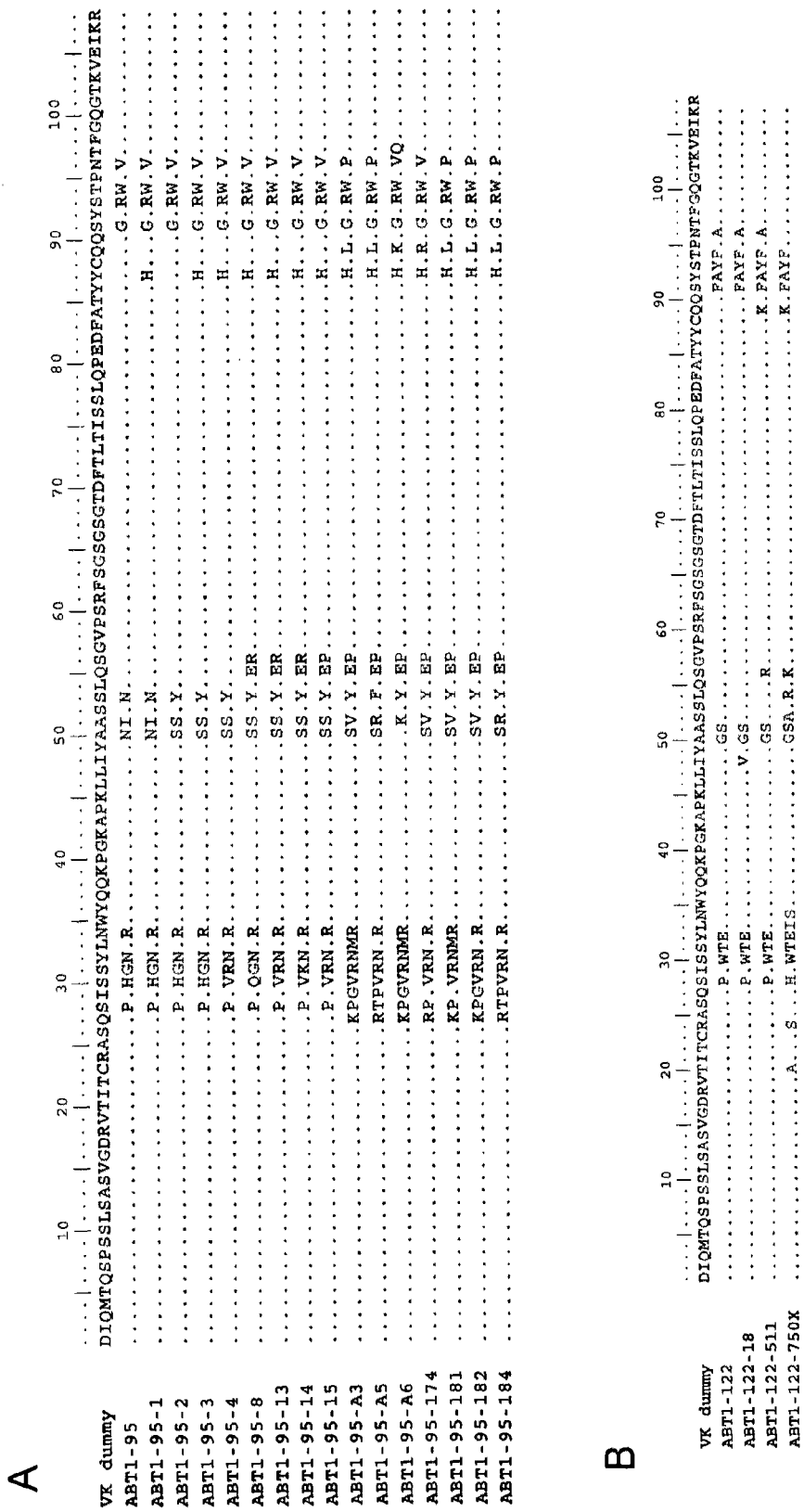
FIGS. 21A to 21D show sequences of ABT1-95 (SEQ ID NOS 93, 12, 941, 942, 127, 943-946, 121, 130, 132, 133, 122 and 124-126, respectively, in order of appearance), ABT1-122 (SEQ ID NOS 93, 24, 948, 97 and 111, respectively, in order of appearance), ABT1-141 (SEQ ID NOS 93, 1292, 113 and 949, 950, respectively, in order of appearance), and ABT2-65 (SEQ ID NOS 53, 44, 86 and 83, respectively, in order of appearance), respectively, clones as maturation has progressed.

For the NNS screening, individual NNS libraries at every diversified position in each CDR (Q27, P28, V30, R31, N32, R34, Y49, S50, S51, Y53, E55, P56, Q89, G91, Y92, R93, W94, V96) were created and screened, with mutations that led to activity improvements combined to create ABT1-95-174 ($ND_{50}$ of 2 pM). ABT1-95-15 was also matured using yeast display with each CDR being individually diversified followed by sorting of the libraries using FACS, then recombination of the outputs followed by further sorting to create ABT1-95-A3, ABT1-95-A5, and ABT1-95-A6. Mutations from the NNS screen identified as potentially detrimental to neutralising activity were removed from ABT1-95-A3 and ABT1-95-A5 to create ABT1-95-181, ABT1-95-182 and ABT1-95-184. FIG. 21A and Table 3 show the changes in both sequence, neutralising activity and affinity that occurred as the maturation of ABT1-95 progressed.

TABLE 3

Summary of the activity improvements of ABT1-95 dAb clones as the maturation program progressed

| Clone | MRC5 $ND_{50}$ | $K_D$ |
|---|---|---|
| ABT1-95 | 1 μM | 200 nM |
| ABT1-95-1 | | 40 nM |
| ABT1-95-2 | | 40 nM |
| ABT1-95-3 | 50 nM | 5-10 nM |
| ABT1-95-4 | 0.9 nM | 0.9 nM |
| ABT1-95-8 | 0.9 nM | 0.9 nM |
| ABT1-95-13 | 110 pM | |
| ABT1-95-14 | 250 pM | |
| ABT1-95-15 | 50-150 pM | |
| ABT1-95-A3 | 11 pM | |
| ABT1-95-A5 | 16 pM | |
| ABT1-95-A6 | 24 pM | |
| ABT1-95-174 | *1-5 pM | |
| ABT1-95-181 | 14 pM | |
| ABT1-95-182 | *1-5 pM | |
| ABT1-95-184 | *1-5 pM | |

*Exceeds sensitivity of the assay 2.1.2 Affinity Maturation of ABT1-122

ABT1-122 was affinity matured by phage display using both libraries diversified by using NNS codons in either CDR1, CDR2 or CDR3 and error-prone PCR with selection taking place under both equilibrium and off-rate conditions. Analyses of the outputs from these selections lead to the identification of ABT1-122-18 which has an $ND_{50}$ of 5 nM compared to the parental $ND_{50}$ of 50 nM.

Libraries, each diversified in blocks of three amino acids scanning across all three CDRs were constructed and sorted by FACS. This resulted in the lead clone ABT1-122-511 which has an $ND_{50}$ of 80 nM when paired with ABT2-108 as an IgG compared to a parental $ND_{50}$ of 1 μM for the same pairing. To mature this lead clone further, each CDR was again individually diversified followed by sorting of the libraries using FACS, then recombination of the outputs followed by further sorting to create ABT1-122-750X which has an $ND_{50}$ in the MRC5 assay as a dAb of 934 pM and $ND_{50}$ of 20 nM in the MRC5 assay when paired as an IgG with ABT2-65-17. FIG. 21B shows the sequences of clones ABT1-122 as maturation progressed. In addition to the sequences described in FIG. 21B (as well as Tables 60 and 64), clone ABT1-122-751x was also created (CDR1 RASQHIWTELN (SEQ ID NO: 951)/CDR2 GSASRQK (SEQ ID NO: 952)/CDR3 KQFAYYPNT (SEQ ID NO: 953)). Table 4 below describes the inhibitory activity of the clones.

TABLE 4

Summary of the activity improvements of ABT1-122 dAb clones as maturation has progressed

| Clone | MRC5 $ND_{50}$ |
|---|---|
| ABT1-122 | 50 nM |
| ABT1-122-18 | 5 nM |
| ABT1-122-511 | ND |
| ABT1-122-750X | 934 pM |

2.1.3 Affinity Maturation of ABT1-141

ABT1-141 was affinity matured by phage display using both libraries diversified using NNS codons in either CDR1, CDR2 or CDR3 and error-prone PCR with selection taking place under both equilibrium and off-rate conditions (FIG. 21C shows the sequences of the maturation process). Analyses of the outputs from these selections identified ABT1-141-25, which has an $ND_{50}$ of 5 nM compared to the parental $ND_{50}$ of 70 nM. An error-prone PCR library based on ABT1-141-25 resulted in ABT1-141-47 which had an improved $ND_{50}$ of 1 nM and ABT1-141-76 which has an identical $ND_{50}$ to ABT1-141-47 but with the added benefit of no framework mutations, compared to the germline DPK9/JK1 scaffold. Inhibitory activity of the identified clones are described in Table 5.

TABLE 5

Summary of the activity improvements of ABT1-141 dAb clones as maturation has progressed

| Clone | MRC5 $ND_{50}$ |
|---|---|
| ABT1-141 | 70 nM |
| ABT1-141-25 | 5 nM |
| ABT1-141-47 | 1 nM |
| ABT1-141-76 | 1 nM |

2.1.4 Affinity Maturation of ABT2-65

ABT2-65 was affinity matured by phage display using both libraries diversified by using NNS codons in either CDR1, CDR2 or CDR3 and error-prone PCR with selection taking place under both equilibrium and off-rate conditions. A number of clones with improved activity in the MRC5 assay were identified from the library where the inner residues in CDR3 had been diversified, the best of which was ABT2-65-17 which has an $ND_{50}$ of 2 nM compared to 266 nM for the parental clone. One framework mutation and an N-linked glycosylation site were present in ABT2-65 and a further framework mutation was present in ABT2-65-17. These were all removed to create the clone ABT2-65-166. Clone sequences are described in FIG. 21D, and inhibitory activity is described in Table 6.

TABLE 6

Summary of the activity improvements of ABT2-65 dAb clones.

| Clone | MRC5 $ND_{50}$ |
|---|---|
| ABT2-65 | 266 nM |
| ABT2-65-17 | 2 nM |
| ABT2-65-166 | 4 nM |

2.2.1 Affinity Maturation of IL-1βdAb ABT2-108 by Yeast Display

Previously ABT2-108 was identified as an anti-human IL-1β VH dAb (see Table 60 and Example 1). ABT2-108 has ~10-100 nM IL-1β neutralizing potency as a dAb and paired IgG. In order to improve the IL-1β neutralization potency to <200-pM, affinity maturation of ABT2-108 was performed in the scFv format by yeast display, using the small scanning library and CDR recombination methods.

The objective of the study was to affinity-mature ABT2-108 by yeast display in the scFv format by the use of small scanning CDR libraries and CDR recombination in order to obtain <200 pM IL-1β neutralization potency when converted into the paired IgG format.

Materials and Methods

Construction of the scFv yeast expression vector. ABT2-108/ABT1-122 scFv was subcloned into pYDs-TEV vector by standard molecular cloning. The complete construct is shown in FIG. 1.

Construction of small CDR scanning libraries Gapped vectors for yeast recombination were generated by long PCR using the pYDs-TEV-2-108/1-122 plasmid as a template and 7 sets of gapped primer pairs (Table 7).

TABLE 7

Gapped Vector Primers (SEQ ID NOS 954-967, respectively, in order of appearace)

| Gap | Forward | Reverse |
|---|---|---|
| 1 | 2-108-Gap1Fwd TGG GTC CGC CAG GCT CCA G | 2-108-Gap1Rev AAA GGT GAA TCC GGA GGC TG |
| 2 | 2-108-Gap2Fwd AAT ACA TAC TAC GCA GAC TCC GTG | 2-108-Gap2Rev TGA GAC CCA CTC GAG ACC |
| 3 | 2-108-Gap3Fwd GAC TCC GTG AAG GGC CGG | 2-108-Gap3Rev ATC CTG CCC AAT ACG TGA G |
| 4 | 2-108-Gap4Fwd CGG TTC ACC ATC TCC CGC | 2-108-Gap4Rev GTA TGT ATT CTT ACC ATC CTG CCC |
| 5 | 2-108-Gap5Fwd CAT CAT CTT TTT GAC TAC TGG GGT C | 2-108-Gap5Rev TTT CGC ACA GTA ATA TAC CGC |
| 6 | 2-108-Gap6Fwd GAC TAC TGG GGT CAG GGA AC | 2-108-Gap6Rev AAC CCG ACC CGT ATA TTT CG |

TABLE 7-continued

Gapped Vector Primers (SEQ ID NOS 954-967, respectively, in order of appearace)

| Gap | Forward | Reverse |
|---|---|---|
| 7 | 2-108-Gap7Fwd TGG GGT CAG GGA ACC CTG | 2-108-Gap7Rev ATG ATG AAC ACC AAC CCG AC |

Figure 2:
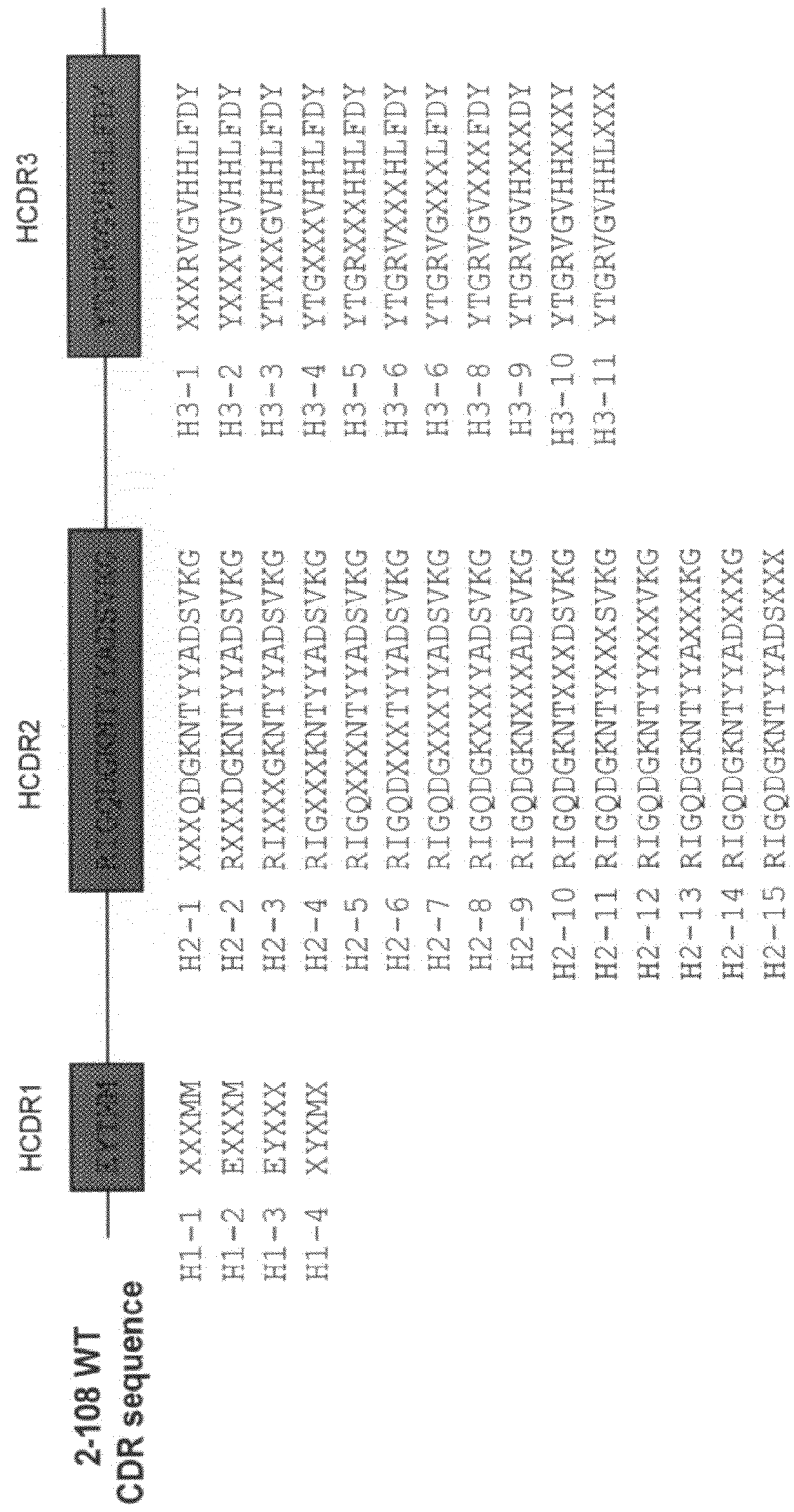
FIG. 2 shows the sequence randomization of HCDRs in the 30 small libraries.

30 long oligos were ordered that span the gaps, 4 for HCDR1, 15 for HCDR2, and 11 for HCDR3. Each oligo contained a series of 9 random nucleotides (NNSNNSNNS, S=C or G), and each subsequent oligo shifted the random sequence down by 3 nucleotides. Each generated library would then randomize only 3 consecutive amino acids, and this window of 3 amino acids would be walked across all 3 HDCRs. One oligo for HCDR1 randomized 3 non-consecutive amino acids. FIG. 2 shows the randomization of HCDRs in the 30 small libraries.

Yeast libraries generation. 30 small yeast libraries were generated via homologous recombination by co-transforming yeast (EBY100) with Gapped vectors and their respective long oligos.

Libraries output sizes were estimated by plating aliquots of transformed cells on SD(-UT) plates.

Yeast libraries labeling and sorting. Expression of scFv fragments on the surface of yeast was induced by growing libraries in SRG(-UT) medium for 48 hours at 20° C.

For library sorting 0.4 OD of yeast cells were labeled with antigen (human IL-1β) at a concentration of 6 nM followed by staining with detection antibody (biotinylated goat polyclonal anti-IL-1β antibody, R&D Systems, Cat# BAF201, at concentration 5 µg/ml) and then Streptavidin-PE (Jackson ImmunoResearch Laboratories, Inc, Cat #016-110-034). ScFv expression was determined by staining libraries with anti-V5 mAb (Invitrogen, Cat# R96025) followed by anti-mouse IgG-FITC (Molecular Probes, Cat # F11021).

Libraries were sorted on the Cytomation MoFlo for 2-3 rounds individually, and then for 1-2 rounds pooled into 6 groups, H1 #1-4, H2 #1-5, H2 #6-10, H2 #11-15, H3 #1-5, and H3 #6-11. For each round of sorting, the top ~0.1% of cells were collected.

The outputs were analyzed for sequence diversity, and individual clones were assayed for IL-1β binding on the surface of yeast. The best clones were converted into IgG and tested for IL-1β neutralization potency in an MRC-5 assay.

Figure 3:
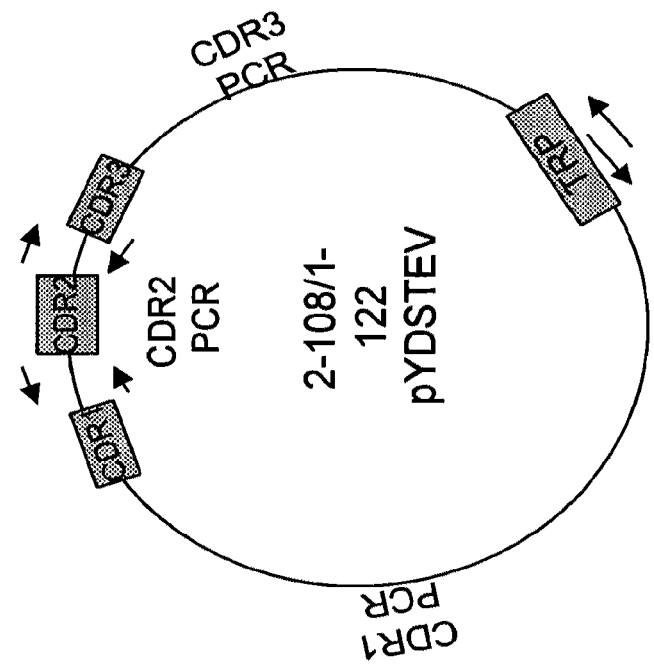
FIG. 3 shows a schematic and sequences used for CDR recombination of clone 2-108. Bold amino acids highlight differences between clone 2-108 and the affinity matured clones.

A 2-108 recombination library was generated by amplifying the HCDR fragments from the best affinity matured clones as well as 2-108 parental for each CDR and then performing homologous recombination in yeast with all the fragments (FIG. 3). One round of sorting was performed on the recombination library using 2 different selection strategies, equilibrium sorting with 60 pM. IL-1β and on-rate sorting with 600 pM IL-1β for 20 minutes labeling. Both outputs were analyzed for sequence diversity, and individual clones were assayed for IL-1β binding on the surface of yeast. The best clones were converted into IgG and tested for IL-1β neutralization potency in a MRC-5 assay.

MRC-5 bioassay. The MRC-5 cell line is a human lung fibroblast cell line that produces IL-8 in response to human IL-1α and IL-1β in a dose-dependent manner. MRC-5 cells were originally obtained from ATCC and subcultured in 10% FBS complete MEM and grown at 37 C in a 5% CO2 incubator. To determine an antibody's neutralizing potency against IL-1a or IL-1b, 4x concentrated Ab (50 ul) was added to a 96 well plate and pre-incubated with 50 ul of 4x concentrated IL-1a or IL-1b for 1 hr at 37 C, 5% CO2. MRC-5 cells at a concentration of 1E5/ml were then added (100 ul) to all wells and the plates were incubated overnight at 37 C in a 5% CO2 incubator. Antibody potency was determined by its ability to inhibit IL-8 production. Human IL-8 production was measured by ELISA.

Results
ABT2-108 Affinity Maturation by Small Scanning CDR Libraries
Improved clones were identified from the selections for all 3 HCDRs, and designated ABT2-108-501 through 532 see Table 8).

TABLE 8

CDR sequences of parental and affinity matured 2-108 clones ("CDR1" sequences disclosed as SEQ ID nos 49, 1164-1168, 1192, 1167, 1167, 1166, 1167 and 1167, "CDR2" sequence disclosed as SEQ ID NOS 50, 1169-1183, 50, 1172, 50, 50, 1181 and1172, "CDR3" sequence disclosed as SEQ ID NOS 51, 1184-1191, 1193-1195, 1184, 1194, 1194, 1184, 1184, and 1184, all respectively, in order of appearance)

| | CDR1 | CDR2 | CDR3 | Clone# |
|---|---|---|---|---|
| ABT-2108 | EYTMM | RIGQDGKNTYYADSVKG | YTGRVGVHHLFDY | WT |
| -501 | WEGMM | | | Apr. 9, 2004 H1-1 scFV R2 6 nM output #1 |
| -502 | MESMM | | | Apr. 30, 2004 H1-1~4 scFv pooled R3 6 nM output #1 |
| -503 | EEKWM | | | Apr. 30, 2004 H1-1~4 scFv pooled R3 6 nM output #2 |
| -504 | DEGMM | | | Apr. 30, 2004 H1-1~4 scPr pooled R3 6 nM output #3 |
| -505 | EYGLI | | | Apr. 30, 2004 H1-1~4 scFv pooled R3 6 nM output #9 |
| -506 | | RCHEDGKNTYYADSVKG | | Apr. 30, 2004 H2-1~5 scFv pooled R2 6 nM output #1 |
| -507 | | RITWTGKNTYYADSVKG | | Apr. 30, 2004 H2-1~5 scFv pooled R2 6 nM output #2 |
| -508 | | RIGYMDKNTYYADSVKG | | Apr. 30, 2004 H2-1~5 scFv pooled R2 6 nM output #4 |
| -509 | | RITYSGKNTYYADSVKG | | Apr. 30, 2004 H2-1~5 scFv pooled R2 6 nM output #5 |
| -510 | | RCVWDGKNTYYADSVKG | | Apr. 30, 2004 H2-1~5 scFv pooled R2 6 nM output #9 |
| -511 | | RIGQDGKNTVIRDSVKG | | Apr. 30, 2004 H2-6~10 scFv pooled R2 6 nM output #1 |
| -512 | | RIGQDGKNTVLRDSVKG | | Apr. 30, 2004 H2-6~10 scFv pooled R2 6 nM output #3 |
| -513 | | RIGQDGKNTVDRDSVKG | | Apr. 30, 2004 H2-6~10 scFv pooled R2 6 nM output #9 |
| -514 | | RIGQDGKNTWTRDSVKG | | Apr. 30, 2004 H2-6~10 scFv pooled R2 6 nM output #10 |
| -515 | | RIGQDGKNTYYRGYMKG | | May 3, 2004 H2-11~15 scFv pooled R2 6 nM output #1 |
| -516 | | RIGQDGKNTYYRVDVKG | | May 3, 2004 H2-11~15 scFv pooled R2 6 nM output #4 |
| -517 | | RIGQDGKNTYYADRTDG | | May 3, 2004 H2-11~15 scFv pooled R2 6 nM output #5 |
| -518 | | RIGQDGKNTYYRMDVKG | | May 3, 2004 H2-11~15 scFv pooled R2 6 nM output #6 |
| -519 | | RIGQDGKNTYARMSVKG | | May 3, 2004 H2-11~15 scFv pooled R2 6 nM output #8 |
| -520 | | RIGQDGKNTYYADRSFG | | May 3, 2004 H2-11~15 scFv pooled R2 6 nM output #9 |
| -521 | | | YTGRILGHHLFDY | Apr. 9, 2004 H3-5a scFv R2 6 nM output #1 |
| -522 | | | YTGRILHHHLFDY | May 3, 2004 H3-1~5 scFv pooled R2 6 nM output #1 |
| -523 | | | YDGWVGVHHLFDY | May 3, 2004 H3-1~5 scFv pooled R2 6 nM output #2 |
| -524 | | | YTGRVFNHHLFDY | May 3, 2004 H3-1~5 scFv pooled R2 6 nM output #6 |
| -525 | | | YTGRILAHHLFDY | May 3, 2004 H3-1~5 scEV pooled R2 6 nM output #9 |
| -526 | | | YTGRVLNHHLFDY | May 3, 2004 H3-6~11 scFv pooled R2 6 nM output #1 |
| -527 | | | YTGRVFKHHLFDY | May 3, 2004 H3-6~11 scFv pooled R2 6 nM output #3 |
| -528 | | | YTGRVLGHHLFDY | May 3, 2004 H3-6~11 scFv pooled R2 6 nM output #6 |
| -529 | EEGMM | | | May 14, 2004 H1-1~4 scFv pooled R4 2 nM output #1 |
| -530 | | | YTGRILEHHLFDY | May 14, 2004 H3-1~5 scFv pooled R3 2 nM output #1 |
| -531 | | | YTGRIFSHHLFDY | May 14, 2004 H3-1~5 scFv pooled R3 2 nM output #3 |
| -532 | | | YTGRIFLHHLFDY | May 14, 2004 H3-1~5 scFc pooled R3 2 nM output #5 |

TABLE 8-continued

CDR sequences of parental and affinity matured 2-108 clones ("CDR1" sequences disclosed as SEQ ID nos 49, 1164-1168, 1192, 1167, 1167, 1166, 1167 and 1167, "CDR2" sequence disclosed as SEQ ID NOS 50, 1169-1183, 50, 1172, 50, 50, 1181 and1172, "CDR3" sequence disclosed as SEQ ID NOS 51, 1184-1191, 1193-1195, 1184, 1194, 1194, 1184, 1184, and 1184, all respectively, in order of appearance)

| CDR1 | CDR2 | CDR3 | Clone# |
|---|---|---|---|
| -533x DEGMM | RIGQDGKNTYYADSVKG | YTGRILGHHLFDY | Aug. 3, 2004 2-108 scFv Recomb R1 s1 60 pM output #4 |
| -534x DEGMM | RITYSGKNTYYADSVKG | YTGRIFSHHLFDY | Aug. 3, 2004 2-108 scFV Recomb R1 s1 60 pM output #9 |
| -535x DEGMM | RIGQDGKNTYYADSVKG | YTGRIFSHHLFDY | Aug. 3, 2004 2-108 scFv Recomb R1 s1 60 pM output #10 |
| -536x EEKWM | RIGQDGKNTYYADSVKG | YTGRILGHHLFDY | Aug. 3, 2004 2-108 scFv Recomb R1 s1 60 pM output #4 |
| -537x DEGMM | RIGQDGKNTYYRMDVKG | YTGRILGHHLFDY | Aug. 3, 2004 2-108 scFv Recomb R1 20 min 600 pM output #2 |
| -538x DEGMM | RITYSGKNTYYADSVKG | YTGRILGHHLFDY | Aug. 3, 2004 2-108 scFv Recomb R1 20 min 600 pM output #6 |

Figure 4:
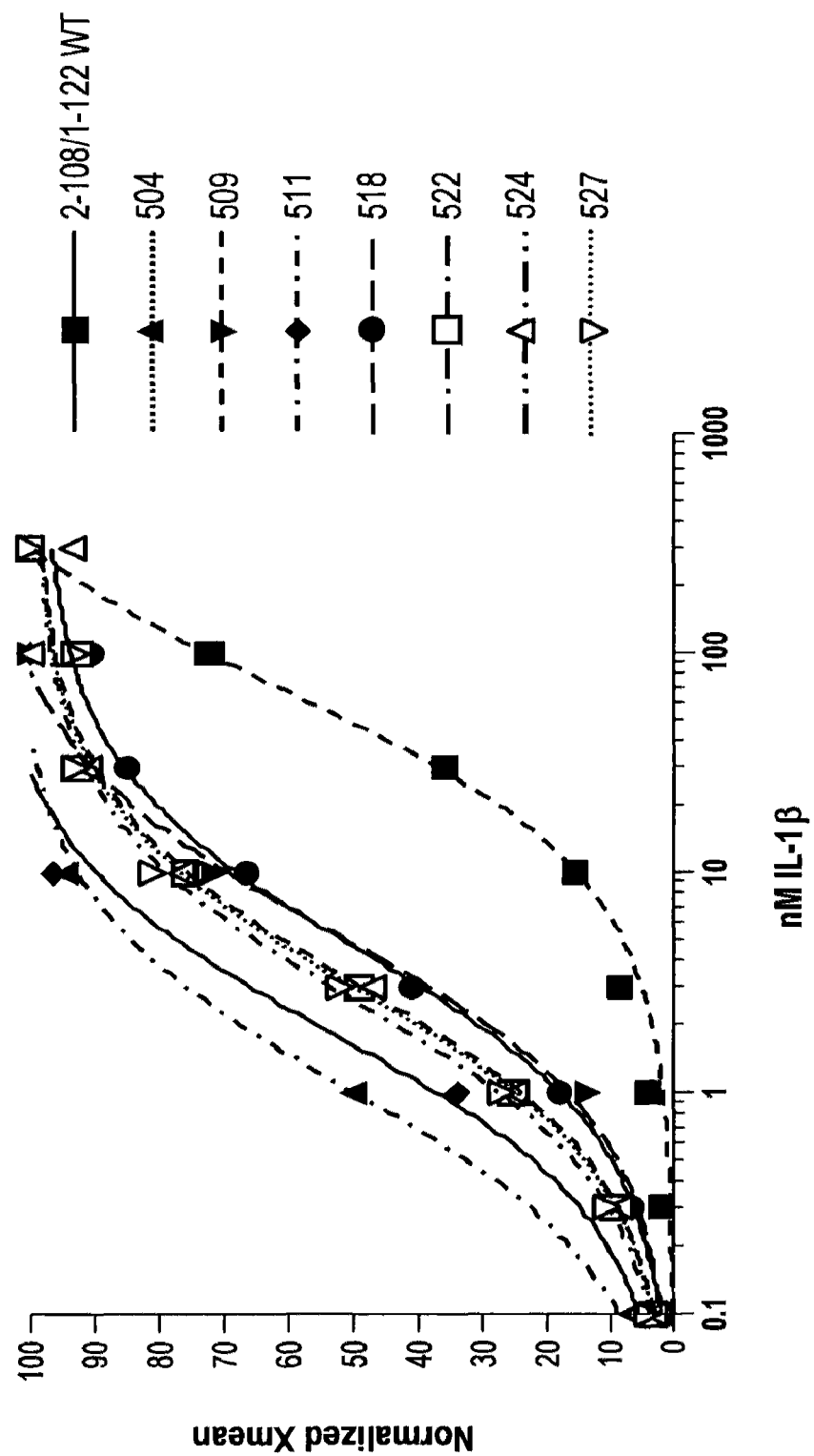
FIG. 4 shows $K_D$ on yeast surface of single CDR affinity matured and parental 2-108 clones.

$K_D$ curves on the surface of yeast for the clones in relation to 2-108 parental were generated, with the best clones showing 1-2 logs improvement in binding affinity (FIG. 4). EC50 values for the clones and wild type were as follows (clone name (EC50 value)): 2-108/1-122 WT (69.29); 504 (1.054); 509 (5.318); 511 (1.848); 518 (4.404); 522 (2.963); 524 (3.103); and 527 (2.596).

Figure 5:
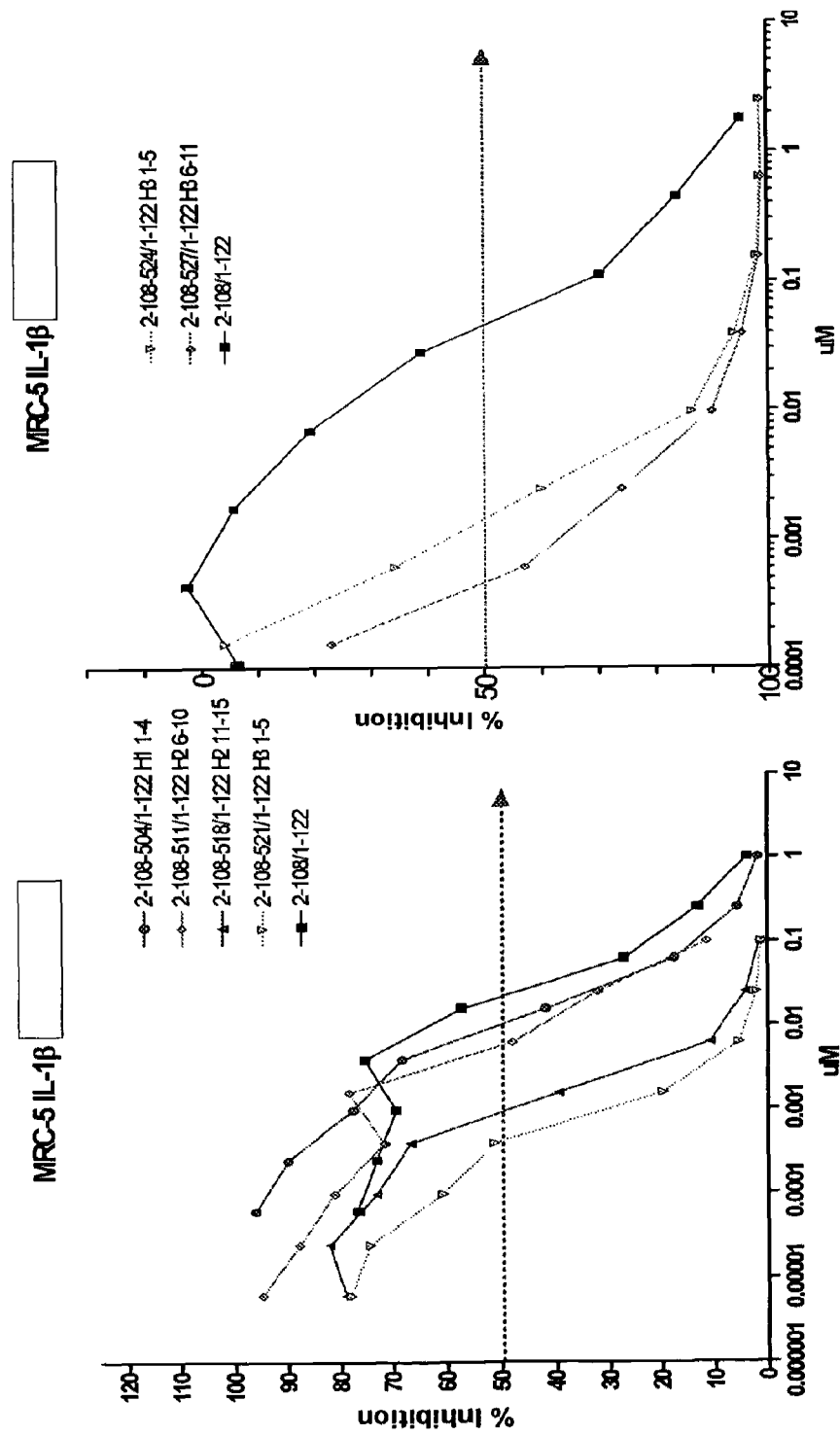
FIG. 5 shows IL-1β neutralization potency of single CDR affinity matured vs parental 2-108 clones as IgG.

The best clones when converted into IgG format paired with ABT1-122 showed greater than 1 log improvement in IL-1β neutralization potency in a MRC-5 assay (FIG. 5).

ABT2-108 Affinity Maturation by CDR Recombination Library

Both the equilibrium and on rate sorting produced several clones with improvement in IL-1β affinity over the single CDR affinity matured clones. Six of these clones were chosen for further analysis, designated ABT2-108-533X through 538X (see Table 9).

TABLE 9

Dual-specificity pairings and neutralization characteristics

| Name | Heavy Chain | Light Chain | IL-1α IC50 (nM) | IL-1β IC50 (nM) |
|---|---|---|---|---|
| ABT2-108/ABT1-122 hu IgG1/K wt | ABT2-108 | ABT1-122 | 150, 500, 1500 | 15, 20, 40 |
| ABT2-108-504/ABT1-122 hu IgG1/K wt | ABT2-108-504 | ABT1-122 | 1500 | 15 |
| ABT2-108-518/ABT1-122 hu IgG1/K wt | ABT2-108-518 | ABT1-122 | 400 | 0.5 |
| ABT2-108-521/ABT1-122 hu IgG1/K wt | ABT2-108-521 | ABT1-122 | 1000 | 0.2, 0.4 |
| ABT2-108-533x/ABT1-122 hu IgG1/K wt | ABT2-108-533x | ABT1-122 | 1000 | 0.025, 0.15 |
| ABT2-108-534x/ABT1-122 hu IgG1/K wt | ABT2-108-534x | ABT1-122 | 1000 | 0.025, 0.035 |
| ABT2-108-537x/ABT1-122 hu IgG1/K wt | ABT2-108-537x | ABT1-122 | 1000 | 0.007, 0.02 |
| ABT2-108-538x/ABT1-122 hu IgG1/K wt | ABT2-108-538x | ABT1-122 | 100, 1000 | 0.007, 0.02, 0.18 |
| ABT2-108-603/ABT1-122 hu IgG1/K wt | ABT2-108-603 | ABT1-122 | 1500 | 10 |
| ABT2-108-605/ABT1-122 hu IgG1/K wt | ABT2-108-605 | ABT1-122 | 20, 2000 | 1.5, 0.35 |
| ABT2-108-612/ABT1-122 hu IgG1/K wt | ABT2-108-612 | ABT1-122 | 100 | 1, 0.45 |
| ABT2-108-617/ABT1-122 hu IgG1/K wt | ABT2-108-617 | ABT1-122 | 150 | 0.05 |
| ABT2-108-620x/ABT1-122 huIgG1/K wt | ABT2-108-620x | ABT1-122 | 150 | 0.05 |
| ABT2-65/ABT1-122 hu IgG1/K wt | ABT2-65 | ABT1-122 | 2000 | 2000 |
| ABT2-65-17/ABT1-122 hu IgG1/K wt | ABT2-65-17 | ABT1-122 | 70, 3000 | 0.1, 0.45 |
| ABT2-65-8/ABT1-122 hu IgG1/K wt | ABT2-65-8 | ABT1-122 | 1000 | 2.7 |

TABLE 9-continued

Dual-specificity pairings and neutralization characteristics

| Name | Heavy Chain | Light Chain | IL-1α IC50 (nM) | IL-1β IC50 (nM) |
|---|---|---|---|---|
| ABT2-108/ABT1-122-505 hu IgG1/K wt | ABT2-108 | ABT1-122-505 | 2000 | 20 |
| ABT2-108/ABT1-122-508 hu IgG1/K wt | ABT2-108 | ABT1-122-508 | 400 | 20 |
| ABT2-65-17/ABT1-122-511 hu IgG1/K wt | ABT2-108 | ABT1-122-510 | 30, 200 | 0.1, 0.16 |
| ABT2-108/ABT1-122-511 hu IgG1/K wt | ABT2-108 | ABT1-122-511 | 40 | 8 |
| ABT2-108-521/ABT1-122-511 hu IgG1/K wt | ABT2-108-521 | ABT1-122-511 | 150 | 0.16 |
| ABT2-108-538x/ABT1-122-511 hu IgG1/K wt | ABT2-108-538x | ABT1-122-511 | 1, 10, 25, 200 | 0.006, 0.009, 0.01 |
| ABT2-108-620x/ABT1-122-511 huIgG1/K wt | ABT2-108-620x | ABT1-122-511 | 10, 40, 200 | 0.01, 0.02, 0.03 |
| ABT2-108-620x/ABT1-122-512 huIgG1/K wt | ABT2-108-620x | ABT1-122-512 | 150 | 0.006 |
| ABT2-108-620x/ABT1-122-513 huIgG1/K w | ABT2-108-620x | ABT1-122-513 | 30, 100 | 0.01, 0.009 |
| ABT2-108/ABT1-122-554 hu IgG1/K wt | ABT2-108 | ABT1-122-554 | 150 | 9 |
| ABT2-108/ABT1-122-555 hu IgG1/K wt | ABT2-108 | ABT1-122-555 | 70 | 7 |
| ABT2-108-538x/ABT1-122-555 hu IgG1/K wt | ABT2-108-538x | ABT1-122-555 | 25 | 0.015 |
| ABT2-108/ABT1-122-556 hu IgG1/K wt | ABT2-108 | ABT1-122-556 | 150 | 15 |
| ABT2-108-620x/ABT1-122-750M hu IgG1 wt | ABT2-108-620x | ABT1-122-750M | 18.46 | 0.00555 |
| ABT2-108-620x/ABT1-122-750MT hu IgG1 wt | ABT2-108-620x | ABT1-122-750MT | 10.14 | 0.00482 |
| ABT2-108-538x/ABT1-122-750x hu IgG1/K wt | ABT2-108-538x | ABT1-122-750x | 4, 10, 100 | 0.005, 0.008, 0.01 |
| ABT2-108-620x/ABT1-122-750x huIgG1/K wt | ABT2-108-620x | ABT1-122-750x | 17.52 | 0.005 |
| ABT2-108/ABT1-141 hu IgG1/K wt | ABT2-108 | ABT1-141 | 1000, 1500, 3000 | 15, 40, 50, 80 |
| ABT2-65/ABT1-141 hu IgG1/K wt | ABT2-65 | ABT1-141 | 7000 | 100 |
| ABT2-65-17/ABT1-141 hu IgG1/K wt | ABT2-65-17 | ABT1-141 | 70 | 0.4 |
| ABT2-65-8/ABT1-141 hu IgG1/K wt | ABT2-65-8 | ABT1-141 | 450 | 0.09 |
| ABT2-108/ABT1-141-25 hu IgG1/K wt | ABT2-108 | ABT1-141-25 | N/A | 150 |
| ABT2-108-521/ABT1-141-25 hu IgG1/K wt | ABT2-108-521 | ABT1-141-25 | 20 | 0.1 |
| ABT2-65-17/ABT1-141-25 hu IgG1/K wt | ABT2-65-17 | ABT1-141-25 | 400 | 1 |
| ABT2-65-17/ABT1-212 hu IgG1/K wt | ABT2-65-17 | ABT1-212 | 100 | 0.5, 0.09 |
| ABT2-65-8/ABT1-212 hu IgG1/K wt | ABT2-65-8 | ABT1-212 | 5000 | 3.5 |
| ABT2-108-538x/ABT1-221 huIgG1/K wt | ABT2-108-538x | ABT1-221 | 200 | 0.01 |
| ABT2-108-538x/ABT1-221 huIgG1/K wt | ABT2-108-538x | ABT1-222 | 200 | 0.01 |
| ABT2-108-538x/ABT1-95-15 huIgG1/K wt | ABT2-108-538x | ABT1-95-15 | 0.9, 4, 10, 19 | 0.003, 0.01, 0.02, 0.03, 0.008 |
| ABT2-108-620x/ABT1-95-15 huIgG1/K wt | ABT2-108-620x | ABT1-95-15 | 5 | 0.04 |
| ABT2-65-166/ABT1-95-15 hu IgG1/K wt | ABT2-65-166 | ABT1-95-15 | 1.89 | 0.13 |
| ABT2-65-17/ABT1-95-15 huIgG1/K wt | ABT2-65-17 | ABT1-95-15 | 0.5, 1, 5, 5.35 | 0.01, 0.04, 0.08, 0.1 |

TABLE 9-continued

Dual-specificity pairings and neutralization characteristics

| Name | Heavy Chain | Light Chain | IL-1α IC50 (nM) | IL-1β IC50 (nM) |
|---|---|---|---|---|
| ABT2-65-201/ABT1-95-15 hu IgG1/K mut (234; 235) | ABT2-65-201 | ABT1-95-15 | 0.652 | 0.03 |
| ABT2-65-166/ABT1-95-184 hu IgG1mut 234, 235/K | ABT2-65-166 | ABT1-95-184 | 0.068 | 0.15 |
| ABT2-108/ABT1-95-3 hu IgG1/K wt | ABT2-108 | ABT1-95-3 | 1500 | 200 |
| ABT2-108-521/ABT1-95-A3 hu IgG1 wt | ABT2-108-521 | ABT1-95-A3 | 0.027 | 0.098 |
| ABT2-108-538x/ABT1-95-A3 hu IgG1mut 234, 235/K | ABT2-108-538x | ABT1-95-A3 | 0.095 | 0.035 |
| ABT2-108-620x/ABT1-95-A3 hu IgG1/K mut (234; 235) | ABT2-108-620x | ABT1-95-A3 | 0.002 | 0.0073 |
| ABT2-65-166/ABT1-95-A3 huIgG1/K wt | ABT2-65-166 | ABT1-95-A3 | 0.026, 0.0178 | 0.17 |
| ABT2-65-166/ABT1-95-A5 hu IgG1mut 234, 235/K | ABT2-65-166 | ABT1-95-A5 | 0.015 | 0.145 |
| ABT2-65-166/ABT1-95-A6 hu IgG1/K wt | ABT2-65-166 | ABT1-95-A6 | 0.019, 0.35 | 0.32 |

Figure 6:
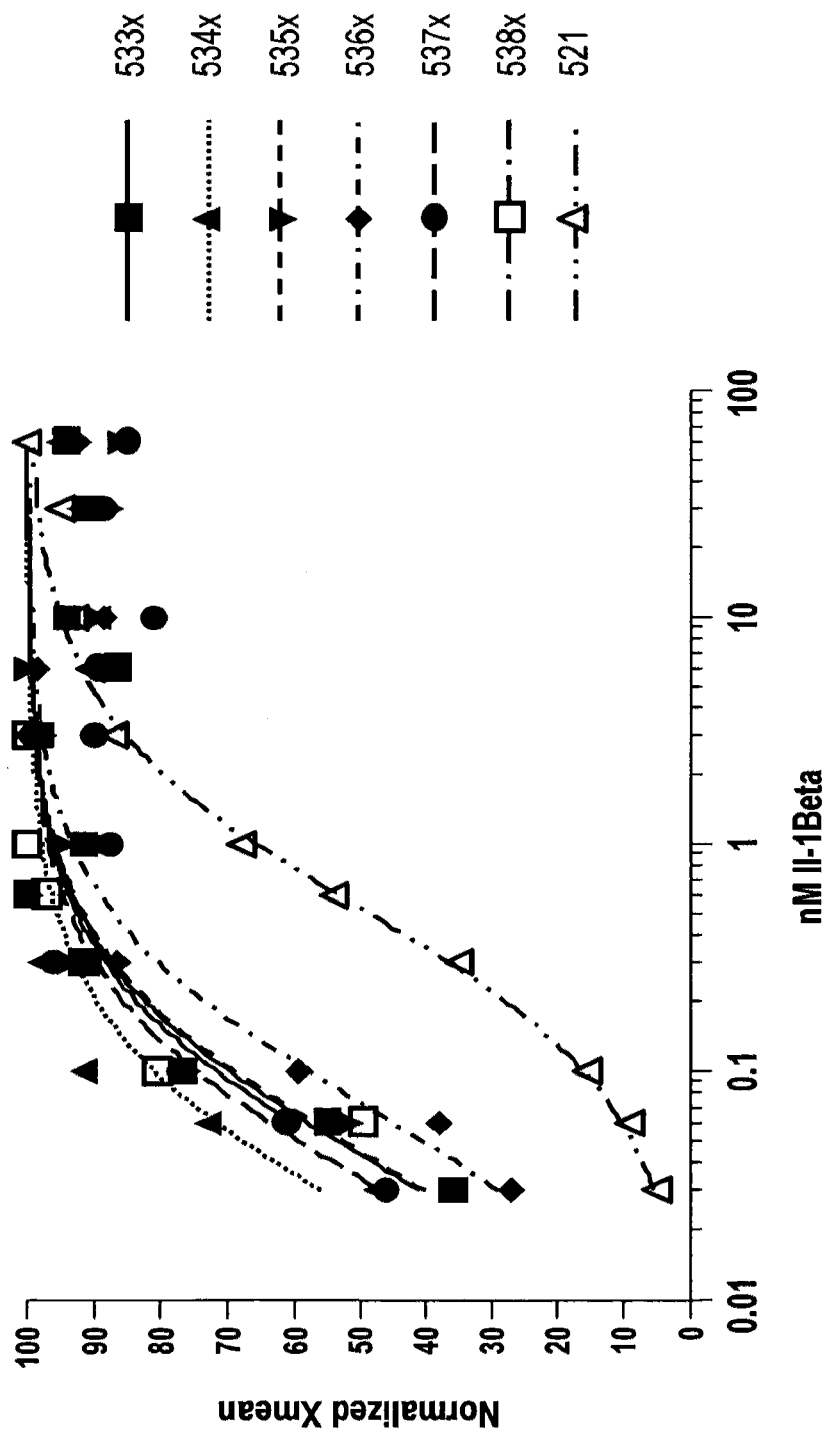
FIG. 6 shows $K_D$ on yeast surface of CDR recombination vs. single CDR affinity matured 2-108 clones.
Figure 7:
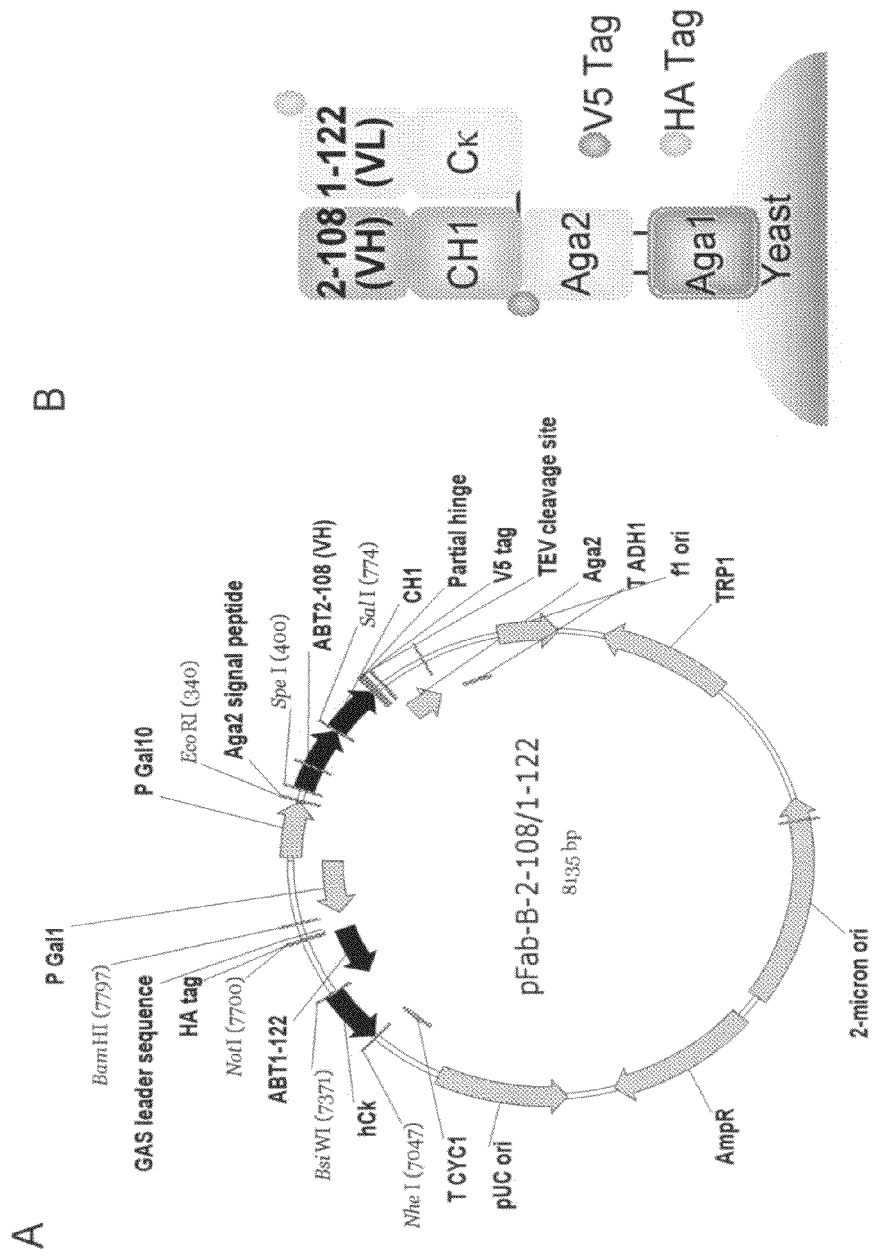
FIG. 7 shows a plasmid map (7A) and schematic representation of Fab expression on yeast surfaces (7B).

All showed greater than 1 log improvement in affinity on the surface of yeast in comparison to one of the best single CDR affinity matured 2-108 clones (FIG. 6). EC50 values for the clones and wild type were as follows (clone name (EC50 value)): 533x (0.04322); 534x (0.2354); 535x (0.04475); 536x (0.07300); 537x (0.03390); 538x (0.03956); and 521 (0.5222).

The best CDR recombination clones when converted into an IgG format paired with 1-122 showed greater than 1 log improvement in IL-1β neutralization potency vs. one of the best single CDR 2-108 affinity matured clones in a MRC-5 assay. EC50 (nM) values were determined as follows (clone name (EC50 value)): 2-108-533x/1-122 (0.03525); 2-108-534x/1-122 (0.02724); 2-108-537x/1-122 (0.006324); 2-108-538x/1-122 (0.005366); 2-108-521/1-122 (0.1878); and MAB201 (0.001218). The EC50 data showed the IL-1β neutralization potency of CDR recombination vs. single CDR affinity matured 2-108 clones as IgG.

In conclusion, the above describes a successful experiment which was able to affinity mature an IL-1β binding dAb in a scFv by yeast display. Through the use of the small scanning libraries and subsequent CDR recombination, multiple clones were identified that improved the affinity of 2-108 for IL-1β by greater than 3 logs. At least 4 of these clones, ABT2-108-533x, 534x, 537x, and 538x, were able to achieve the target goal of better than 200 pM neutralization potency for IL-1β in a MRC-5 assay when converted to an IgG format.

2.2.2 Affinity Maturation of Anti-Il-1α DAb Abt1-95-15 by Yeast Display

ABT1-95 was previously identified as an anti-human IL-1α Vκ dAb (see Example 1 and Table 60). ABT1-95 had low IL-1α neutralizing potency as a dAb and insignificant potency when converted into IgG. Using an emulsion technology and CDR mutagenesis, an improved ABT1-95-15 clone (dAb $IC_{50}$ in the low pM range) was generated (see above Example 2.1), with confirmed its improved potency ($IC_{50}$~5 nM) in the IgG format with pairing heavy chains ABT2-108 or ABT2-65 lineages (anti-IL-1β VH dabs).

Since it is difficult to further improve the low pM affinity of ABT1-95-15 in the dAb format, affinity maturation of ABT1-95-15 was performed in the scFv format by yeast display.

The objective of this study was to affinity-mature ABT1-95-15 by yeast display in the scFv format by large CDR spiking libraries to sub-nM affinity and potency in the IgG format.

Materials and Methods

Figure 11:
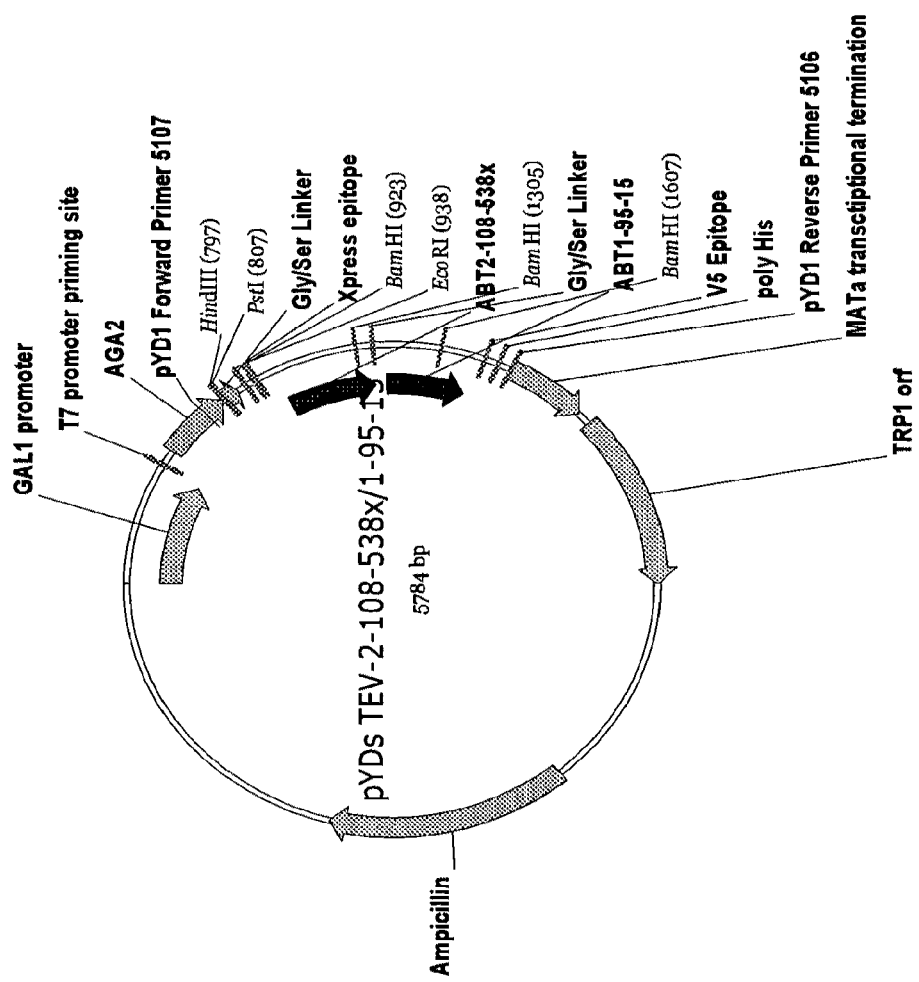
FIG. 11 shows the plasmid map of pYDs-TEV-2-108-538x/1-95-15.

Construction of the scFv yeast expression vector. ABT1-95-15 (VL to IL-1α) and ABT2-108-538x (VH to IL-1β) were subcloned into pYDs-TEV vector by standard molecular cloning. The complete construct is shown in FIG. 11.

Construction of large CDR spiking libraries. The pYDs-TEV plasmid was linearized with Sfi I and Not I restriction enzymes and purified.

ABT2-108-538x/ABT1-95-15 scFv fragment DNA was produced by overlapping PCRs with ABT1-95-15 framework primers, pYD vector specific primers, and long oligonucleotide primers containing mutations in each of the three ABT1-95-15 CDRs. The mutations were introduced by synthesizing the CDR region sequences at nucleotide ratio 70-10-10-10 (70%—original nucleotide, the other three nucleotides—10% each), (Table 10).

TABLE 10

Primers used for large CDR spiking libraries construction

| Name | Oligo Sequence | SEQ ID NO: |
|---|---|---|
| 1-95-15-L1[a] | CATCCTCCCTGTCTGCATCTGTAG-GAGACCGTGTCA CCATCACTTGCCGGGCAAGTCAGCCGAT-TGTGCGGA ACTTAAGGTGGTATCAGCAGAAACCAGG | 968 |
| 1-95-15-L2[a] | TGGTATCAGCAGAAACCAGGGAAAGC-CCCTAAGCTC CTGATCTATTCTTCGTCCTATTTGGAGC-CCGGGGTC CCATCACGTTTCAGTGGTAGTGGATCCG | 969 |
| 1-95-15-L3[a] | ACTCTCACCATCAGCAGTCTGCAAC-CCGAAGATTTT GCTACGTACCACTGTCAACAGGGG-TATCGTTGGCCT GTTACGTTCGGCCAAGGGACCAAGGTGG | 970 |
| 1-122 Gap 1 Rev new | GCAAGTGATGGTGACACGGTCTCCTACAGATGC | 971 |
| 1-122 Gap 3 Rev new | ATAGATCAGGAGCTTAGGGGCTTTCCCTGG | 972 |

TABLE 10-continued

Primers used for large CDR spiking libraries construction

| Name | Oligo Sequence | SEQ ID NO: |
|---|---|---|
| 1-95 Gap 4 Rev | ACAGTGGTACGTAGCAAAATCTTCG | 973 |
| pYD1 Fwd | AGTAACGTTTGTCAGTAATTGC | 974 |
| ABTVKSCFV Rev | TTAGGGATAGGCTTACCTTCGAAGGGC-CCTCTAGA CTCGAGGGCGGCCGCACGTTTGATTTC-CACCTTGG | 975 |

<sup>a</sup>Sequences in bold are spiked

Figure 12:
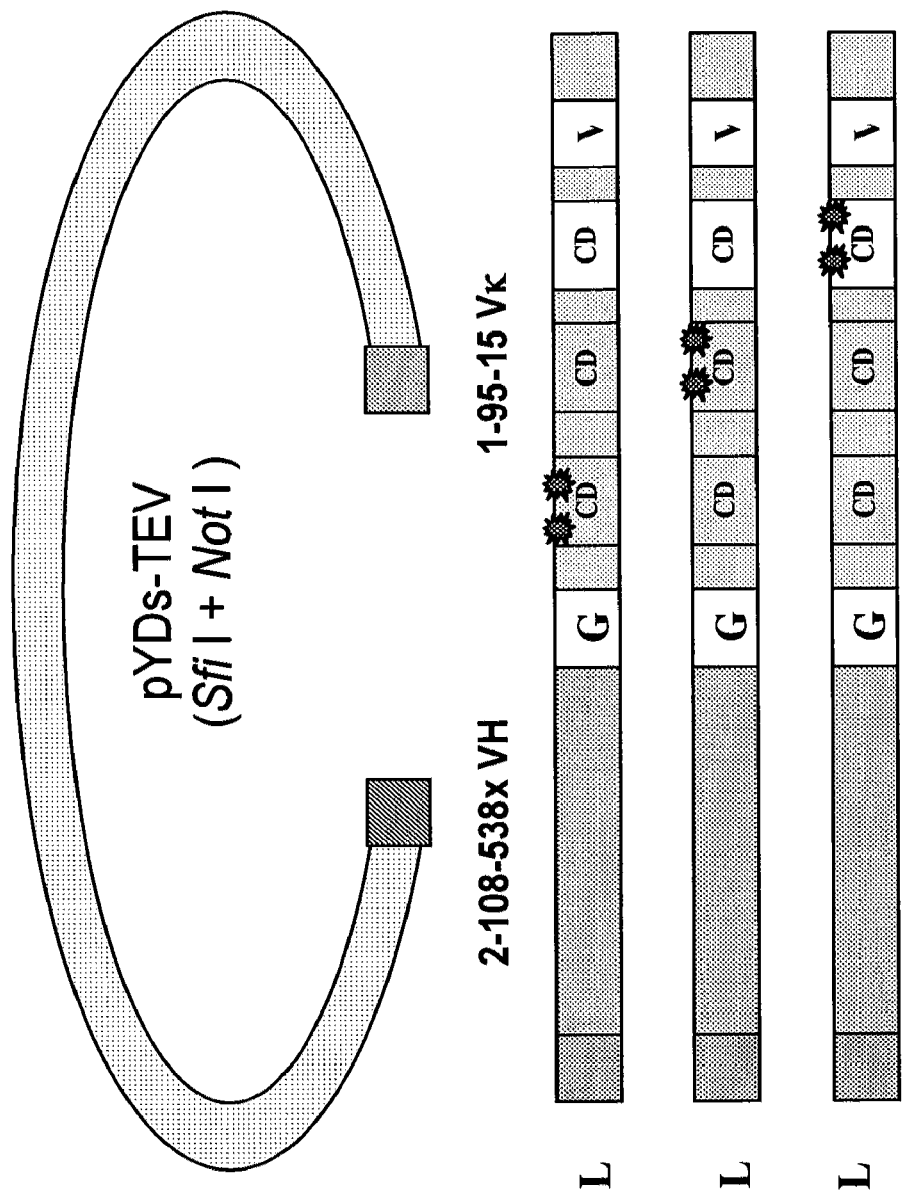
FIG. 12 provides a diagram of the yeast CDR spiking libraries construction.

Yeast libraries generation and QC Large yeast libraries were generated via homologous recombination by co-transforming yeast (EBY100) with linearized vector and PCR fragments with spikes in each of ABT1-95-15 CDRs in (FIG. 12).

Libraries output sizes were estimated by plating aliquots of transformed cells on SD(-UT) plates. Libraries diversity was verified by sequencing analysis of 24 individual colonies from each library.

Yeast libraries labeling and sorting. Expression of scFv fragments on the surface of yeast was induced by growing libraries in SRG(-UT) medium for 48 hours at 20° C.

For equilibrium library sorting yeast cells ($5 \times 10^8$ cells for each library at first round) were labeled with antigen (human IL-1α) at a concentration of 660 pM followed by staining with detection antibody (biotinylated goat polyclonal anti-IL-1α antibody, R&D Systems, Cat# BAF200, at concentration 5 μg/ml) and then Streptavidin-PE (Jackson ImmunoResearch Laboratories, Inc, Cat #016-110-034). ScFv expression was determined by staining libraries with anti-V5 mAb (Invitrogen, Cat# R96025) followed by anti-mouse IgG-FITC (Molecular Probes, Cat# F11021).

For off-rate sorts aliquots of round 1 outputs ($9–25 \times 10^7$ cells) were labeled with human IL-1α at 10 nM concentration followed by competition with IL-1α specific IgG (ABT2-65-17/ABT1-95-15 A-897661.0) at concentration 100 μg/ml for 60-80 minutes (3 to 4 half-lives). Antigen, still bound to the yeast surface was detected as described above.

Round 2 outputs ($8–20 \times 10^6$ cells) were subsequently sorted for round 3 as described above, except that competition time was 100 min.

Fourteen to twenty-eight clones from each library Round 3 output were analyzed by sequencing. Three clones from each sorting outputs were also analyzed on the surface of yeast for their affinity improvement.

Figure 13:
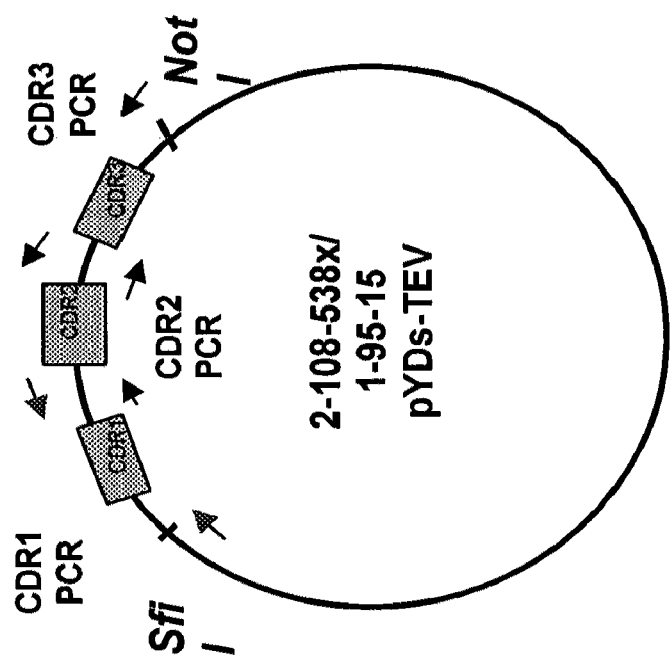
FIG. 13 shows ABT-95-15 CDR recombination library construction.

CDR1 fragments from ABT1-95-15 L1 round 3 output, CDR2 fragments from ABT1-95-15 L2 round 3 output, and CDR3 fragments from ABT1-95-15 L3 round 3 output were mixed with linearized pYDs-Tev vector and transformed into EBY100 yeast cells to generate ABT1-95-15 CDR recombination library (FIG. 13)

Off-rate sort with competition for 3 hours (Round 1), 8 hours (Round 2) and 15 hours (Round 3) was used for CDR recombination library sortings. Round 3 output of CDR recombination library was analyzed by sequencing and 6 clones were selected for analysis on the surface of yeast. Best clones were converted into IgG paired with VH clones of 2-108 and 2-65 lineages.

Results
ABT1-95-15 Affinity Maturation by Large Single CDR Spiking Libraries

Figure 14:
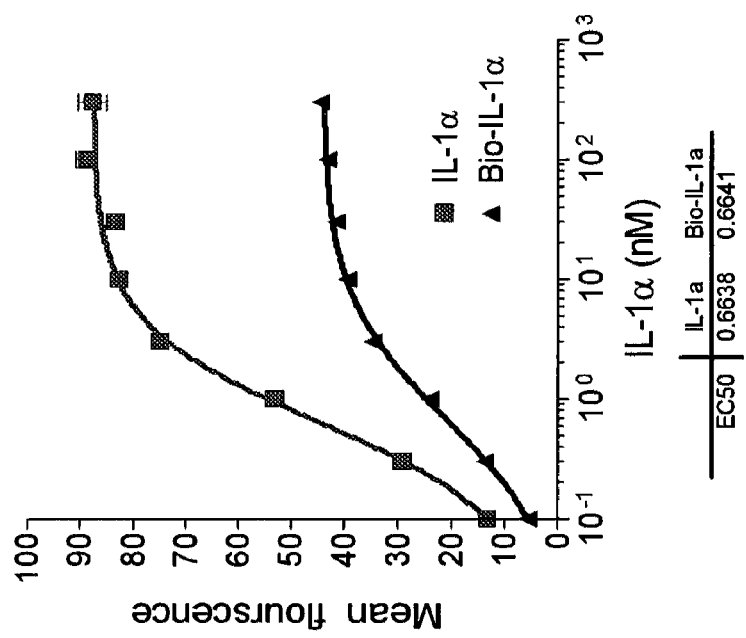
FIG. 14 provides results of shows $K_D$ analysis of ABT2-108-538x/ABT1-95-15 scFv on yeast surface.
Figure 15:
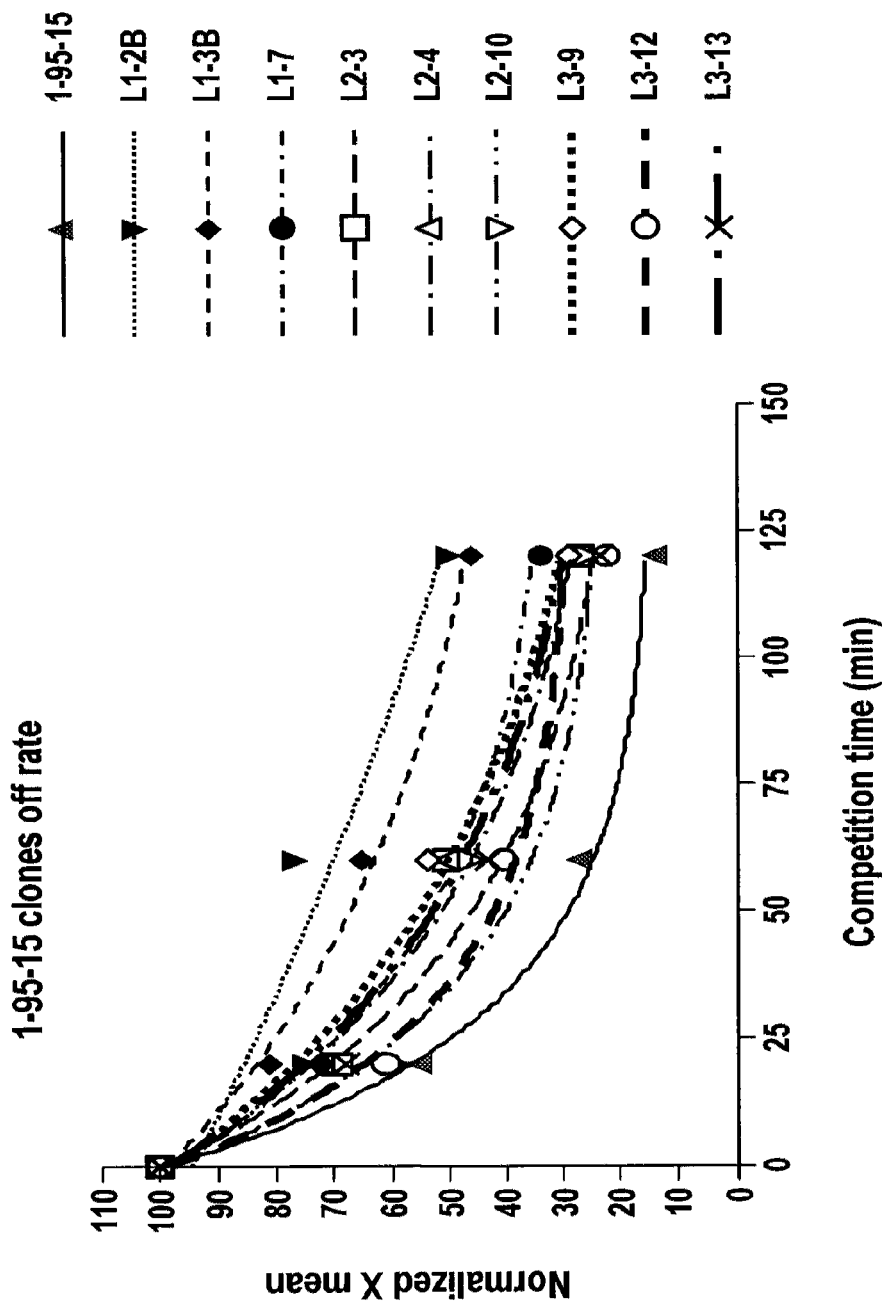
FIG. 15 provides off-rate analysis if the single CDR mutants on yeast surface.

Estimated libraries output sizes for ABT1-95-15 libraries were $2–5 \times 10^7$. Libraries QC analysis confirmed the presence of designed mutations in all CDR spiking libraries. Equilibrium sort was used for first round selection to remove non-binders for IL-1α antigen. The libraries were labeled at $K_D$ of ABT2-108-538x/ABT1-95-15 scFv with 660 pM human IL-1α (see FIG. 14). Off-rate selection was used in subsequent library selections. Half-life of ABT1-95-15/IL-1α complex on the surface of yeast was determined to be 20 min (see FIG. 15). Half life values were determined as follows (clone name (half life)): 1-95-15 (19.77); L1-2B (162.7); L1-3B (52.56); L1-7 (31.56); L2-3 (38.26); L24 (39.47); L2-10 (21.43); L3-9 (46.10); L3-12 (23.62); and L3-13 (32.08).

Based on three rounds of sorting results for the three ABT1-95-15 individual CDR libraries (data not shown), all three libraries showed some improvement over ABT1-95-15 after three rounds of sorting.

Sequencing results of round 3 library selection output are listed in Table 11.

TABLE 11

Sorting results for ABT1-95-15 affinity maturation by large single CDR libraries ("CDR1" sequences disclosed as SEQ ID NOS 1196, 1196, 1198-1218, "CDR2" sequences disclosed as SEQ ID NOS 1197, 1197, 1219-1227 and "CDR3" sequences disclosed as SEQ ID NOS 11, 11 and 1228-1231, all respectively, in order of appearance)

| Clone | CDR1 | CDR2 | CDR3 | Frequency |
|---|---|---|---|---|
| ABT1-95-15 | RASQPIVRNLR | SSSYLEP | QQGYPWPVT | |
| a) | RASQPIVRNLR | | | 2 |
|  | RASQSNLRNLR | | | 1 |
|  | RASRTPVRNLR | | | 1 |
|  | RANRTRVRNLR | | | 2 |
| L1-2B | RKNNPFVRNLR | | | 4 |
|  | RKNHPNMRNLR | | | 1 |
|  | RKNHPHIRNLR | | | 1 |
| L1-7 | RKTHPTVRNLR | | | 2 |
|  | RKAHPMVRNLR | | | 1 |
|  | RKLQPFVRNLR | | | 1 |
|  | RKSSPMVRNLR | | | 1 |
|  | LKRHPSVRNLR | | | 1 |
|  | LKRQPSVRNLR | | | 1 |
| L1-3B | RKSHPFVRNLR | | | 2 |
|  | RASQTRVQNLR | | | 1 |
|  | RARRAPVRNLR | | | 1 |
|  | RARNTPVRNLR | | | 1 |
|  | RASRPNVRNLR | | | 1 |
|  | RASRPIVRNLR | | | 1 |
|  | RGSRPGIRNLR | | | 1 |
|  | RRSGPNVRNLR | | | 1 |
|  | LKSHPHVRNLR | | | 1 |
| b) | | SSSYLEP | | 1 |
| L2-4 | | SVSYLEP | | 4 |
| L2-3 | | SRSYLEP | | 2 |
| L2-10 | | SKSYLEP | | 2 |
|  | | SVSWLEP | | 1 |
|  | | SISYLEP | | 1 |
|  | | STKNVER | | 1 |
|  | | SWSFLQP | | 1 |
|  | | SSNYLAP | | 1 |
|  | | ARSYLEP | | 1 |
| c) | | | QQGYRWPVT | 10 |
|  | | | RMGYRWPVT | 1 |

TABLE 11-continued

Sorting results for ABT1-95-15 affinity maturation by large single CDR libraries ("CDR1" sequences disclosed as SEQ ID NOS 1196, 1196, 1198-1218, "CDR2" sequences disclosed as SEQ ID NOS 1197, 1197, 1219-1227 and "CDR3" sequences disclosed as SEQ ID NOS 11, 11 and 1228-1231, all respectively, in order of appearance)

| Clone | CDR1 | CDR2 | CDR3 | Frequency |
|-------|------|------|------|-----------|
| L3-10 | | | KAGYVWPVP | 1 |
| L3-12 | | | KAGYRWPVT | 1 |
| L3-13 | | | RSGYRWPVT | | a) Clones from CDR1 library (L1)
b) Clones from CDR2 library (L2)
c) Clones from CDR3 library (L3)

Sequencing results showed that round 3 selection outputs for all 3 libraries were diverse, with most diversity observed in CDR1 library (L1). CDR3 library (L3) was least diverse and majority of the clones had parental CDR3 sequence.

Three clones from each library were selected for the analysis on the surface of yeast based on their frequency. Off-rate analysis for these clones on yeast surface is presented in FIG. 15.

All analyzed clones showed improvement (2-5 fold) in their off-rates over parental clone ABT1-95-15, and the most improvement was observed in clones from the CDR1 library (L1).

ABT1-95-15 CDR Recombination Library

Round three library outputs for individual CDR libraries were recombined in yeast to generate an ABT1-95-15 CDR recombination library (data not shown).

Significant improvement in off-rate over parental clone ABT1-95-15 was observed in the first round of library sorting. Additional rounds of sorting with increasing competition time with IL-1α-specific IgG ABT2-65-17/ABT1-95-15 did not lead to better discrimination between the best clones and the rest of population. The reason for this was probably the fact that off-rate for IgG competitor was much faster then for affinity-matured clones and therefore the competitor ABT2-65-17/ABT1-95-15 IgG had become inefficient for antigen competition. As a result, round 3 sorting output for CDR recombination library was very diverse (see Table 12).

Six clones from ABT1-95-15 CDR Recombined Library Round 3 output (ABT1-95-A1, -A2, -A3, A4, A5 and -A6) were selected for further analysis on yeast surface based on their frequency and frequencies of their individual CDRs.

Figure 16:
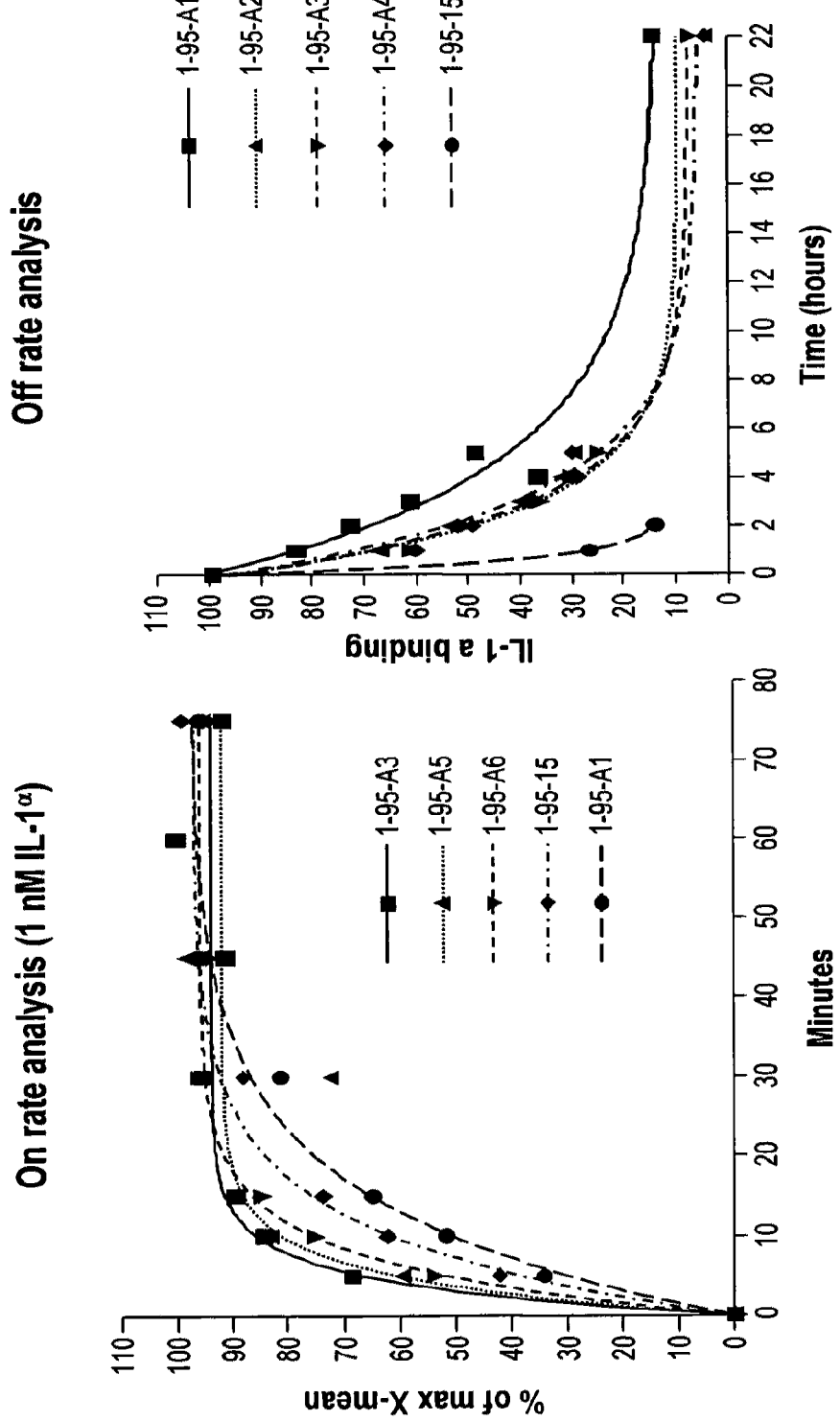
FIG. 16 describe an on rate and off rate analysis of affinity-matured ABT1-95-15 clones on yeast surface.
Figure 17:
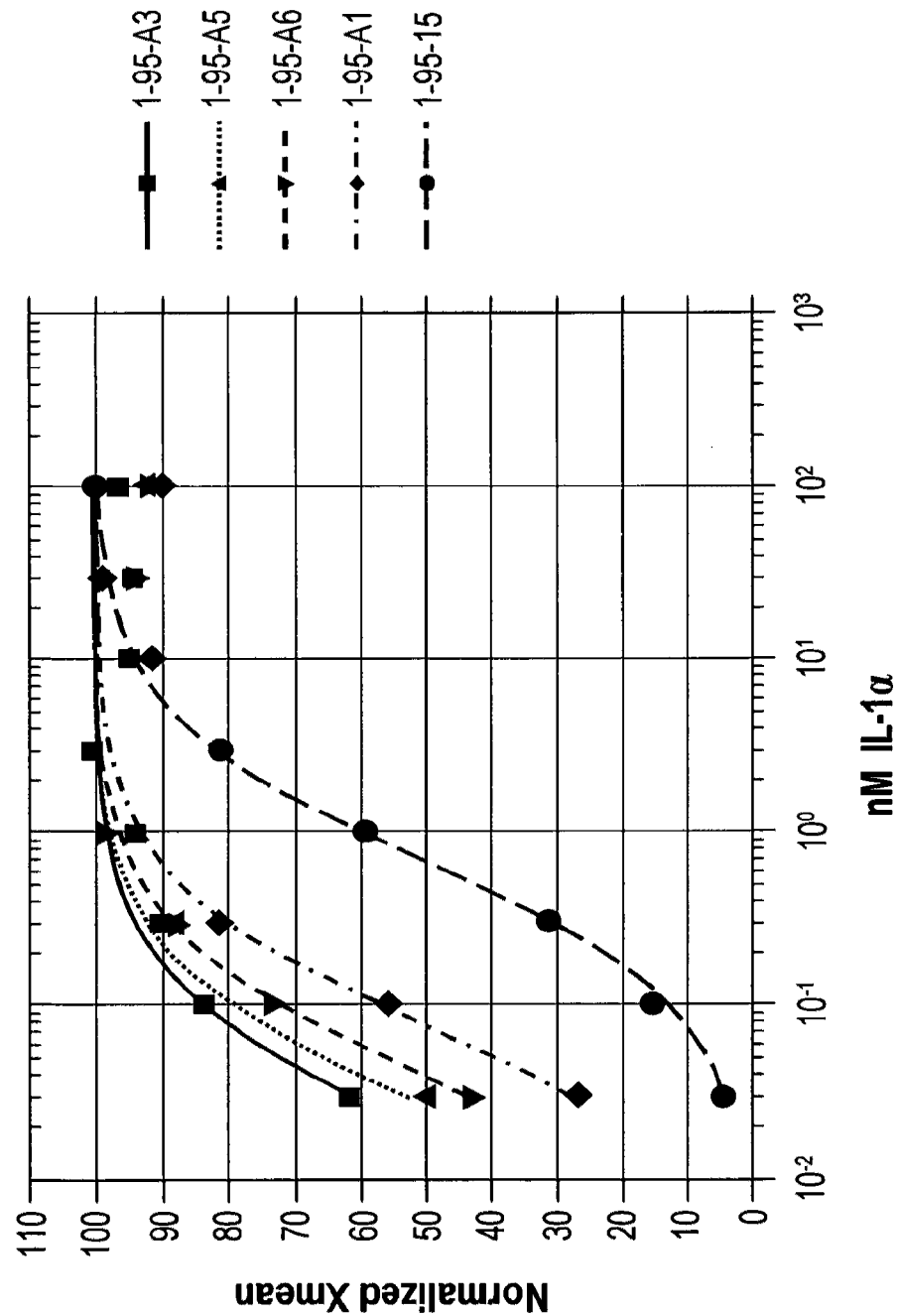
FIG. 17 describes an analysis of affinity-matured ABT1-95-15 clones on yeast surface.

On-rate, off-rate and $K_D$ analysis of these clones on yeast surface is presented in FIGS. 16 and 17. A 10 to 30 fold improvement was observed in $K_D$ on yeast surface for affinity matured clones. On rate analysis half life was determined to be the following (clone name (half life)): 1-95-A3 (2.817); 1-95-A5 (3.244); 1-95-A6 (4.485); 1-95-15 (6.924); amd 1-95-A1 (9.449). Off rate analysis half life was determined to be (clone name (half life)): 1-95-A3 (1.795); 1-95-A2 (2.235); 1-95-A4 (1.991); 1-95-A6 (1.795); 1-95-15 (0.3978); amd 1-95-A1 (3.132). EC50 values were determined to be (clone name (EC50 value)): 1-95-A3 (0.01982); 1-95-A5 (0.02668); 1-95-A6 (0.03965); 1-95-A1 (0.7647); 1-95-15 (0.6731).

TABLE 12

1-95-15 CDR Recombined Library Round3 sorting out- puts ("CDR1" sequences disclosed as SEQ ID NOS 1196, 1232, 1232, 1232, 1232, 1232, 1232, 1232-1233, 1233-1234, 1234, 1234, 1234, 1234, 1216, 1216, 1199, 1235, 1235 and 1235-1244, "CDR2" sequences disclosed as SEQ ID NOS 1197, 1219, 1219, 1219, 1245, 1245, 1221, 1246, 1219, 1222, 1247, 1247-1248, 1219, 1249, 1248, 1250, 1247-1248, 1219, 1251-1253, 1219, 1254, 1219, 1255-1256, 1197 and 1221, "CDR3" sequences disclosed as SEQ ID NOS 11, 1257, 11, 1258-1259, 11, 11, 11, 1257, 1260, 1257, 11, 1260, 1257, 1260, 1257, 11, 1257-1258, 11, 11, 11, 1229, 11, 11, 11, 11, 11 and 11, all respectively, in order of annearance)

| Clone | CDR1 | CDR2 | CDR3 | Frequency |
|-------|------|------|------|-----------|
| ABT1-95-15 | RASQPIVRNLR | SSSYLEP | QQGYRWPVT | |
| ABT1-95-A3 | RASKPGVRNMR | SVSYLEP | LQGYRWPPT | 11 |
| | RASKPGVRNMR | SVSYLEP | QQGYRWPVT | 1 |
| | RASKPGVRNMR | SVSYLEP | RQGYRWPVT | 1 |
| ABT1-95-A6 | RASKPGVRNMR | AKSYLEP | KQGYRWPVQ | 2 |
| | RASKPGVRNMR | AKSYLEP | QQGYRWPVT | 1 |
| | RASKPGVRNMR | SKSYLEP | QQGYRWPVT | 1 |
| | RASKPGVRNMR | SSSYLNP | QQGYRWPVT | 2 |
| | RASKAGVRNLR | SVSYLEP | LQGYRWPPT | 1 |
| | RASKAGVRNLR | SVSWLEP | RQGYVWPVP | 1 |
| ABT1-95-A4 | RASRPGVRNLR | SRSFLEP | LQGYRWPPT | 2 |
| | RASRPGVRNLR | SRSFLEP | QQGYRWPVT | 1 |
| | RASRPGVRNLR | SVSFLEP | RQGYVWPVP | 1 |
| | RASRPGVRNLR | SVSYLEP | LQGYRWPPT | 1 |
| ABT1-95-A1 | RASRPGVRNLR | HVSDLEP | RQGYVWPVP | 4 |
| | RGSRPGIRNLR | SVSFLEP | LQGYRWPPT | 1 |
| | RGSRPGIRNLR | ASSNLEP | QQGYRWPVT | 1 |
| ABT1-95-A5 | RASRTPVRNLR | SRSFLEP | LQGYRWPPT | 2 |
| | QASQPGVRNMR | SVSFLEP | RQGYRWPVT | 1 |
| | QASQPGVRNMR | SVSYLEP | QQGYRWPVT | 1 |
| | QASQPGVRNMR | STSSLQP | QQGYRWPVT | 1 |
| ABT1-95-A2 | RILQPPGRNLR | SKSFLEP | QQGYRWPVT | 6 |
| | RASHGGVRNLR | SASYLEP | QQGYRWPVT | 1 |
| | RASHSPVRNLR | SVSYLEP | KAGYVWPVP | 1 |
| | RAGHPRVRNLR | SSSYLQP | QQGYRWPVT | 1 |
| | RASNQRVRNLR | SVSYLEP | QQGYRWPVT | 2 |
| | RKNHPDVRNLR | SSSLLEP | QQGYRWPVT | 1 |
| | RKSQPNMRNLR | STSLLDR | QQGYRWPVT | 1 |
| | RASQPGVRNLR | SSSYLEP | QQGYRWPVT | 2 |
| | RASQPSVRNLR | SKSYLEP | QQGYRWPVT | 1 |

Based on the $K_D$ analysis on yeast surface, clones ABT1-95-A3, -A5 and -A6 were selected for conversion into IgG format with a pairing heavy chain containing $V_H$ of ABT2-108 and ABT2-65 lineages. MRC-5 assays demonstrated up to 1000-fold improvement in IL-1α neutralization potency for the affinity-matured clones. MRC-5 IL-1a (50 pg/ml IL-1a) inhibition assay values (EC50 nM) were determined to be 0.004457 for ABT2-108-620x/ABT1-95-A3 compared with 5.074 ABT2-108-620x/ABT1-95-15 (controls IL-1RA=0.6996 and MAB200=0.07000).

In conclusion, the above example demonstrates that it is possible to affinity mature an anti-IL-1αVκ domain antibody ABT1-95-15 to low pM potency by yeast display in the scFv format. The three CDRs were mutated by spiking in 30% of mutating nucleotides in the CDR regions, which resulted in three very large yeast libraries. These libraries were selected for improved clones through three rounds of sorting, followed by the generation of a large CDR recombination library to combine all CDR mutations present in the round 3 selection outputs. This approach maximizes the chance to identify CDR mutations that are beneficial to the antigen affinity without pre-determining the mutation positions within the CDRs as they are determined by random and low frequency mutagenesis. The subsequent CDR recombination library approach seeks to identify individual CDR mutations that are compatible with one another that as a whole further the affinity improvement of these mutants. This method is time efficient.

2.3. Affinity Maturation of IL-1α/β Dual-Specific Antibodies by a Yeast Surface Fab Expression System Two domain antibodies (anti-IL-1β VH dAb ABT2-108 and anti-IL-1α Vκ dAb ABT1-122), identified from single domain antibody library selections (described above in Example 1) were chosen for affinity maturation by yeast display. Both Fab and scFv expression systems were employed to carry out the affinity maturation works. This example focuses on the affinity maturation works by the Fab expression system.

The objective of the study was to develop a yeast surface Fab expression system for the affinity maturation of two IL-1 dAb leads.

Materials and Methods

Figure 9:
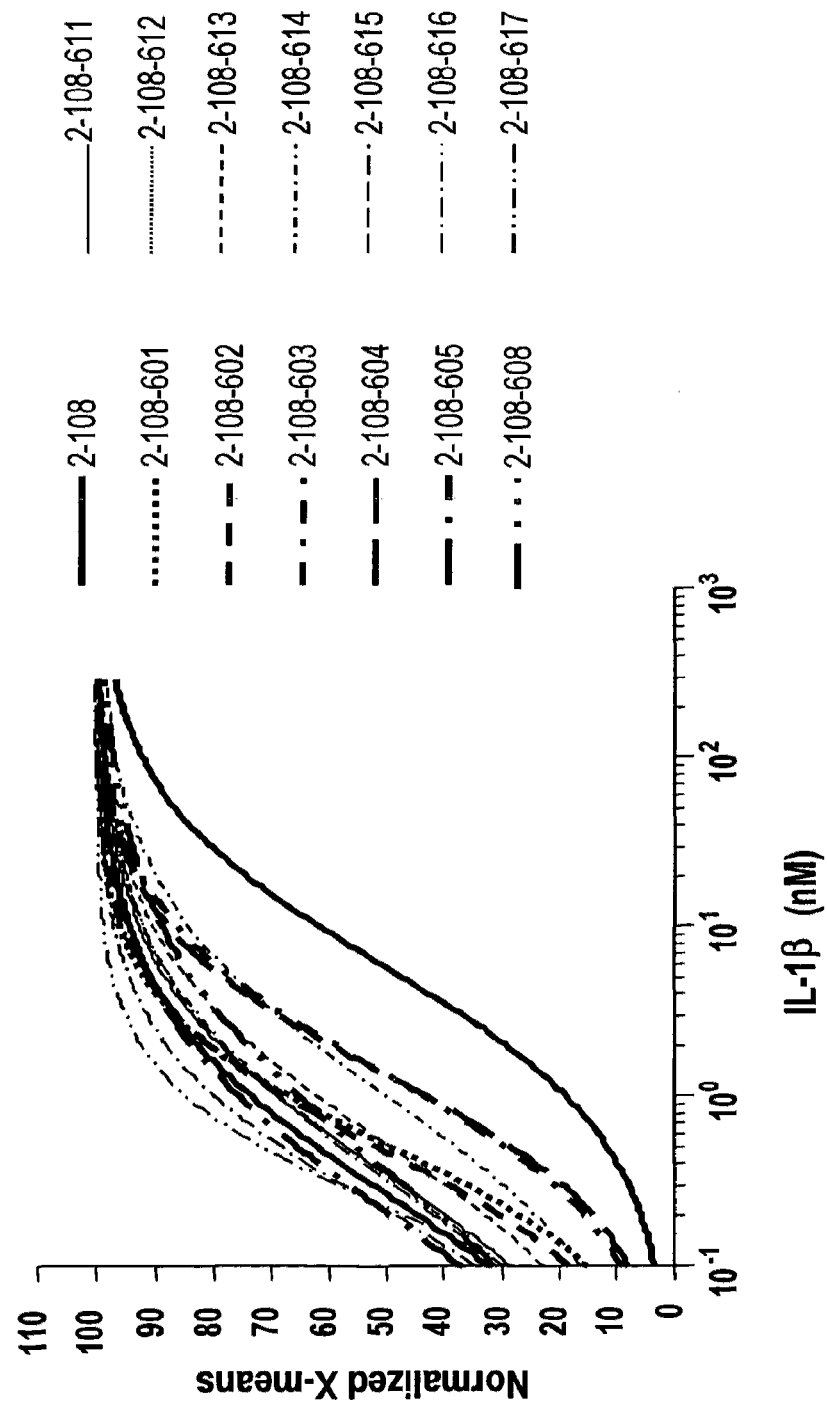
FIG. 9 shows analysis of 2-108 clones on yeast surface.

Construction of a Fab expression vector. The pFab-B vector was based on the pESC-Trp vector (Stratagene) for expressing Fab proteins on yeast surface. Both ABT2-108 and ABT1-122 were subcloned into the pFab-B vector by standard molecular cloning methods. The completed pFab-B-2-108/1-122 vector is shown in FIG. 9.

Construction of mini-libraries. Gapped Fab vectors were generated by PCR amplification using Platinum HiFi DNA polymerase (Invitrogen) and 'gap primers' that flanks each CDRs. The PCR amplification produced 'gapped vectors' in which 15 to 21 nucleotides were deleted from pFabB-2-108/1-122, leaving a gap across the CDR of interest. Seven gapped vectors were generated for ABT 2-108 (1 for CDR1, 3 for CDR2, and 3 for CDR3) and five gapped vectors for ABT 1-122 (2 for CDR1, 1 for CDR2, and 2 for CDR3). Primers used for gapped vectors generation are listed below in Table 13.

Thirty homologous recombination oligos were made for ABT2-108 and twenty-one oligos were made for ABT1-122. These oligos contained the 15-21 nucleotides removed in the gapped vectors as well as about 40 nucleotide-flanking sequences both up- and downstream of the gap. Each homologous recombination oligos randomizes three consecutive amino acids in the CDR gap.

TABLE 13

PCR primers used for gapped vectors generation

| Name | Oligo sequence | SEQ ID NO: |
|---|---|---|
| 2-108 Gap 1 Fwd new | TGGGTCCGCCAGGCTCCAGGGAAGGGTCTC | 1040 |
| 2-108 Gap 1 Rev new | AAAGGTGAATCCGGAGGCTGCACAGGAGAG | 1041 |
| 2-108 Gap 2 Fwd new | AATACATACTACGCAGACTCCGTGAAGGGC | 1042 |
| 2-108 Gap 2 Rev new | TGAGACCCACTCGAGACCCTTCCCTGGAGC | 1043 |
| 2-108 Gap 3 Fwd new | GACTCCGTGAAGGGCCGGTTCACCATCTCC | 1044 |
| 2-108 Gap 3 Rev new | ATCCTGCCCAATACGTGAGACCCACTCGAG | 1045 |
| 2-108 Gap 4 Fwd new | CGGTTCACCATCTCCCGCGACAATTCCAAG | 1046 |
| 2-108 Gap 4 Rev new | GTATGTATTCTTACCATCCTGCCCAATACG | 1047 |
| 2-108 Gap 5 Fwd new | CATCATCTTTTTGACTACTGGGGTCAGGGAAC | 1048 |
| 2-108 Gap 5 Rev new | TTTCGCACAGTAATATACCGCGGTGTCCTC | 1049 |
| 2-108 Gap 6 Fwd new | GACTACTGGGGTCAGGGAACCCTGGTCACC | 1050 |
| 2-108 Gap 6 Rev new | AACCCGACCCGTATATTTCGCACAGTAATATAC | 1051 |
| 2-108 Gap 7 Fwd | TGGGGTCAGGGAACCCTG | 966 |
| 2-108 Gap 7 Rev | ATGATGAACACCAACCCGAC | 967 |
| 1-122 Gap 1 Fwd new | ACTGAGTTAAATTGGTATCAGCAGAAACCAGG | 1052 |
| 1-122 Gap 1 Rev new | GCAAGTGATGGTGACACGGTCTCCTACAGATGC | 1053 |
| 1-122 Gap 2 Fwd new | TGGTATCAGCAGAAACCAGGGAAAGCCCTAAG | 1054 |
| 1-122 Gap 2 Rev new | CGGCTGACTTGCCCGGCAAGTGATGGTG | 1055 |
| 1-122 Gap 3 Fwd new | GGGGTCCCATCACGTTTCAGTGGCAGTGG | 1056 |
| 1-122 Gap 3 Rev new | ATAGATCAGGAGCTTAGGGGCTTTCCCTGG | 1057 |
| 1-122 Gap 4 Fwd new | GCTACGTTCGGCCAAGGGACCAAGGTGGAAATC | 1058 |
| 1-122 Gap 4 Rev new | ACAGTAGTACGTAGCAAAATCTTCAGGTTGCAG | 1059 |
| 1-122 Gap 5 Fwd new | TTCGGCCAAGGGACCAAGGTGGAAATCAAACG | 1060 |
| 1-122 Gap 5 Rev new | AGCAAACTGTTGACAGTAGTACGTAGCAAAATC | 1061 |

Yeast libraries generation and QC. Yeast mini-libraries were generated via homologous recombination by co-transforming yeast (EBY100) with gapped vectors and corresponding homologous recombination oligos.

Libraries output sizes were estimated by plating aliquots of transformed cells on SD(-UT) plates. Libraries diversity was verified by sequencing analysis of 5 individual colonies from each library.

Yeast libraries labeling and sorting. Expression of Fab fragments on the surface of yeast was induced by growing libraries in SRG(-UT) medium for 48 hours at 20° C.

Aliquots of libraries ($4 \times 10^6$ cells for each library) were labeled with antigen (IL-1α or IL-1β) at defined concentrations, followed by staining with detection antibodies (biotinylated goat polyclonal anti-IL-1α antibody, R&D Systems, Cat # BAF200, at concentration 5 µg/ml, or biotinylated goat polyclonal anti-IL-1β antibody, R&D Systems, Cat # BAF 201, at concentration 5 µg/ml), and then straptavidin-PE. Fab expression was determined by staining libraries with either anti-HA mAb 12C5 (Roche) or anti-human Cκ (AbCam, Cat# Ab1050), followed by anti-mouse IgG-FITC (Molecular Probes).

ABT2-108 libraries were individually sorted for Round 1 at antigen (IL-1β) concentration 220 pM. R1 outputs were sorted individually and in pools at antigen concentration 220 pM (Round 2). Pooled R2 outputs were sorted at antigen concentration 220 pM and 110 pM (Round 3). Ten clones from each pooled R3 output were analyzed by sequencing ABT1-122 libraries were individually sorted for Round 1 at antigen (IL-1α) concentration 100 nM. R1 outputs were sorted individually and in pools at antigen concentration 100 nM (Round 2). Pooled R2 outputs were sorted at antigen concentration 50 nM (Round 3) Pooled R3 outputs were sorted at antigen concentration 20 nM (Round 4). Ten clones from each pooled R3 and R4 output were analyzed sequencing.

Identified clones were analyzed for their KD on the surface of yeast. Clones with improved KD were converted into full-length IgG and expressed in COS cells. ABT2-108 CDR recombination libraries generation and sorting CDR1 fragments were PCR amplified from ABT2-108, -601, -602, and -618 using primers 2-108-CDR1F (Table 14) and 2-108Gap2Rev-new. CDR2 fragments were PCR amplified from ABT2-108, -603, -604, -605, -606, -607, -607, -609, -610, -611, -615, and -619 using primers 2-108-CDR2F and 2-108-CDR2R. CDR3 fragments were amplified from ABT2-108, -612, -613, -614, -616, and -617 using primers 2-108Gap4Fwd-new and 2-108-CDR3R. Overlapping CDR fragments were transformed into and homologously recombined in EBY100 cells with either ABT1-122 or ABT1-122-511 pairing light chain to generate CDR recombination libraries. The estimated library output sizes are 2.2×10⁵ for ABT1-122-paired library and 3.4×10⁵ for ABT1-122-511-paired library. Twelve colonies from each library were sequenced for QC.

TABLE 14

PCR primers used in CDR amplification for recombination libraries

| Name | Oligo Sequence | SEQ ID NO: |
|---|---|---|
| 2-108-CDR1F | CAAGTATTTCGGAGTGCCTGAAC | 1062 |
| 2-108-CDR2F | GTCCGCCAGGCTCCAGGGAAAGG | 1063 |
| 2-108-CDR2R | TCGCACAGTAATATACCGCGGTG | 1064 |
| 2-108-CDR3R | GCATTGGTGACTATTGAGCACGTG | 1065 |

Two rounds of on-rate sorting were performed for these two libraries. Round 1 was selected by labeling library with 500 pM biotinylated IL-1β for 15 minutes incubation. Round 2 was selected with both 250 pM and 500 pM biotinylated IL-1β for 15 minutes incubation. Eight clones from the 500 pM R2 sorts and 4 clones from the 250 pM R2 sorts were sequenced from each library. An clone ABT2-108-620x identified from the R2 selection was chosen for conversion into IgG and tested by MRC-5 assay.

Results

ABT2-108 Affinity Maturation

Figure 8A:
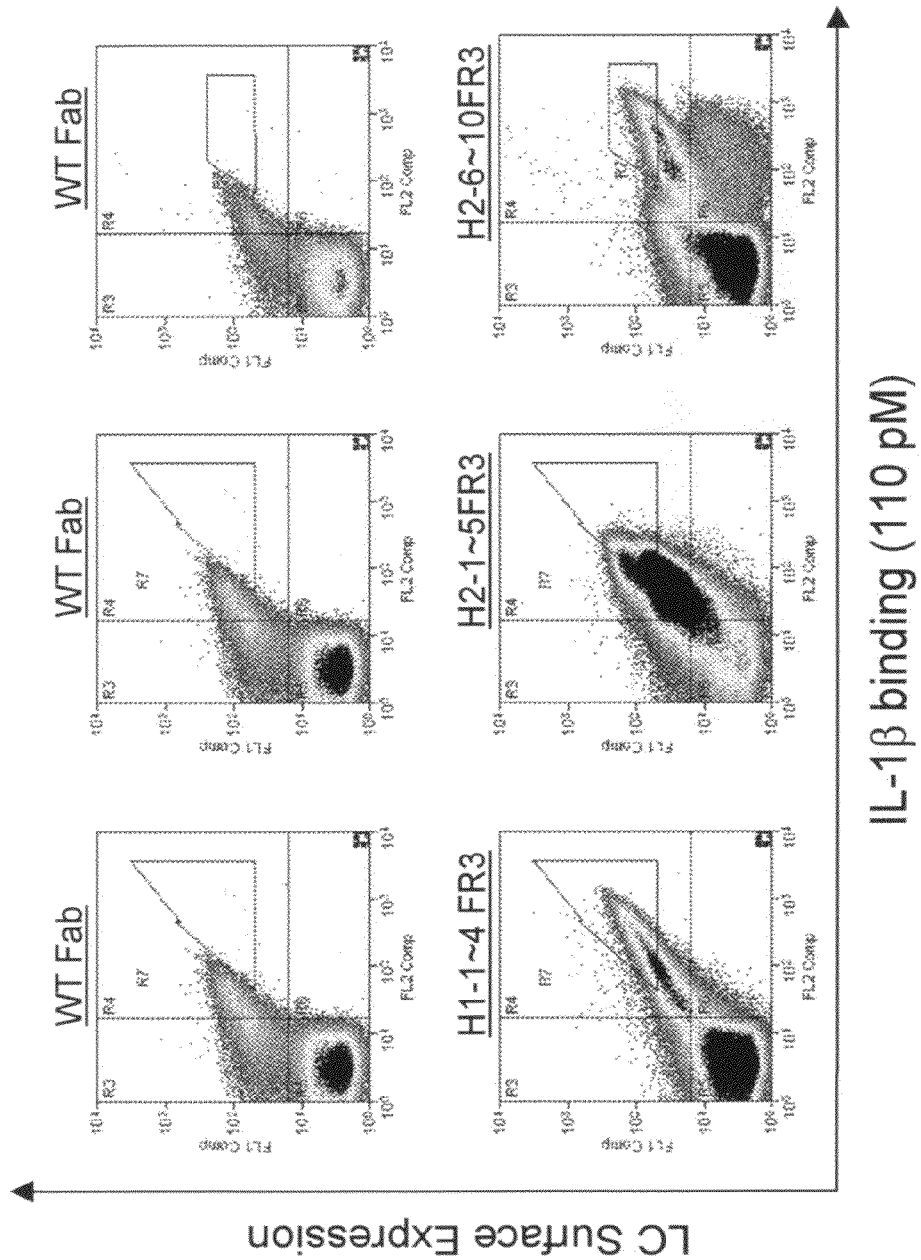

Estimated libraries output sizes for ABT2-108 libraries were 6×10⁴ to 3×10⁵. Libraries QC analysis confirmed the presence of designed mutations for most of the libraries. Some colonies however showed mixed CDR sequences presumably due to an initial uptake of more then one copy of the plasmid by yeast cell. Sorting results for ABT2-108 affinity maturation are shown in FIG. 8.

All 6 pooled libraries showed improved binding to IL-1β at concentration of 110 pM IL-1β after 3 rounds of sorting. Sequencing analysis of individual clones from round 3 outputs (Table 15) revealed existence of hot spots for mutagenesis. The same hot spots and similar or identical mutations were identified during ABT2-108 affinity maturation in yeast display ScFv format.

TABLE 15

Sorting outputs for ABT2-108 affinity maturation ("CDR1" sequences disclosed as SEQ ID NOS 49 and 1261-1263, "CDR2" sequences disclosed as SEQ ID NOS 50 and 1264-1274 and "CDR3" sequences disclosed as SEQ ID NOS 51 1275-1279, all respctively, in order of appearance)

| Clone # | CDR1 | CDR2 | CDR3 | Frequency |
|---|---|---|---|---|
| ABT2-108 | EYTMM | RIGQDGKNTYYADSVKG | YTGRVGVHHLFDY | |
| -601 | EESWM | | | 28 |
| -602 | EEKYM | | | 1 |
| -603 | | RITDAGKNTYYADSVKG | | 14 |
| -604 | | RVTYDGKNTYYADSVKG | | 2 |
| -605 | | RIGQDGKNTYYREDVKG | | 8 |
| -606 | | RIGQDGKNTYYRSSVKG | | 1 |
| -607 | | RIGQDGKNTYYRSDVKG | | 1 |
| -608 | | RIGQDGKNTYTRDSVKG | | 3 |
| -609 | | RIGQDGKNTVYRDSVKG | | 3 |

TABLE 15-continued

Sorting outputs for ABT2-108 affinity maturation ("CDR1" sequences disclosed as SEQ ID NOS 49 and 1261-1263, "CDR2" sequences disclosed as SEQ ID NOS 50 and 1264-1274 and "CDR3" sequences disclosed as SEQ ID NOS 51 1275-1279, all respctively, in order of appearance)

| Clone # | CDR1 | CDR2 | CDR3 | Frequency |
|---|---|---|---|---|
| -610 | | RIGQDGKNTVVRDSVKG | | 1 |
| -611 | | RIGQDGKNTVLRDSVKG | | 2 |
| -612 | | | YTGRIMGHHLFDY | 3 |
| -613 | | | YTGRVFENHLFDY | 6 |
| -614 | | | YTGRILRHHLFDY | 6 |
| -615 | | RIGQDGKNTVIRDSVKG | | 1 |
| -616 | | | YTGRIYNHHLFDY | 2 |
| -617 | | | YTGRIFTHHLFDY | 2 |
| -618 | EEYFM | | | 3 |
| -619 | | RHGWDGKK-YYADSVKG | | 7 |

KD analysis of identified clones on the surface of yeast (FIG. 9) showed improvements in affinity from 5 fold (ABT2-108-604) to 25 fold (ABT2-108-615, -617). EC50 values of the clones were as follows (clone name (EC50 nM): 2-108 (5.778); 2-108-601 (0.5225); 2-108-602 (0.4741); 2-108-603 (1.349); 2-108-604 (1.348); 2-108-605 (0.2096); 2-108-606 (0.3432); 2-108-608 (0.3657); 2-108-611 (0.3508); 2-108-612 (0.2674); 2-108-613 (0.5273); 2-108-614 (1.010); 2-108-615 (0.2145); 2-108-616 (0.3237); and 2-108-617 (0.2236).

Six improved clones (ABT2-108-601, -603, -605, -612, -613 and -617) were converted into IgG constructs and expressed in COS cells paired with ABT1-122 light chain.

MRC-5 analysis of these clones showed significant improvement in neutralization potency (by at least 20-100 fold when compared with the parental ABT2-108) for clones ABT2-108-605, -612, -613 and -617.

ABT1-122 Affinity Maturation

Estimated libraries output sizes for ABT1-122 libraries were $8 \times 10^4$ to $3 \times 10^5$. Libraries QC analysis again showed mixed CDR sequences in many libraries, presumably due to initial uptake of more than one copy of the plasmid by yeast cell. Furthermore, some of the clones were found to contain multiple repeats of the recombination oligos and several clones showed single base insertion or deletion in the coding region. In all, only 25% of the clones analyzed had sequences with designed mutations in appropriate CDRs. Three libraries covering the 3' half of CDR3 were not sorted due to high background of parental vector during library construction.

Figure 10:
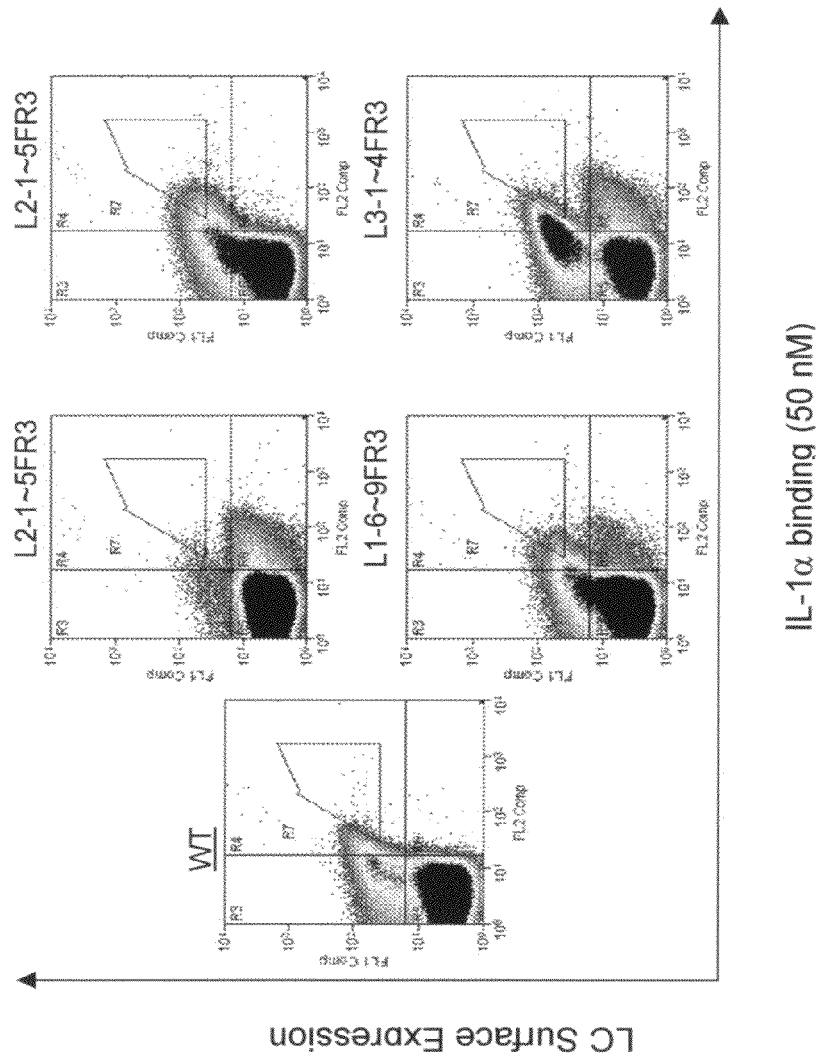
FIG. 10 shows sorting results for ABT 2-122 affinity maturation.

Sorting results for ABT1-122 affinity maturation are shown in FIG. 10. None of the pooled ABT1-122 libraries showed significant improvement in IL-1α binding after 3 rounds of sorting. Many clones in these libraries showed lack of the staining with anti-human Cκ antibody, presumably due to frame-shifting mutations occurred during libraries construction.

Sequencing analysis of individual clones from Round 3 outputs is shown below in Table 16.

TABLE 16

Sorting outputs for 1-122 affinity maturation ("CDR1" sequences disclosed as SEQ ID NOS 21 and 1280-1281, "CDR2" sequences disclosed as SEQ ID NOS 50 and 1264-1274 and "CDR3" sequences disclosed as SEQ ID NOS 1286-1289, all respctively, in order of appearance)

| Clone # | CDR1 | CDR2 | CDR3 | Frequency |
|---|---|---|---|---|
| ABT1-122 | RASQPIWTELN | GSSSLQS | QQFAYFPATF | |
| -501 | RFSYPIWTELN | | | 2 |
| -502 | RAVYLIWTELN | | | 1 |
| -503 | | | EQFAYFPATF | 2 |
| -504 | | | KQFAYFSATF | 1 |
| -505 | | | KQFAYFPATF | 9 |
| -506 | | GSMHTQS | | 1 |
| -507 | | RSSSLQS | | 1 |
| -508 | | GSSSLQR | | 1 |
| -509 | | GHAELQS | | 8 |

None of the identified clones, when analyzed on the surface of yeast, showed improvements in KD, even though they were much brighter than the parental clone ABT1-122. Similar results (i.e. lack of improved IL-1α-binding clones) were found by affinity-maturing ABT1-122 in the scFv format.

Three of the identified Fab clones (ABT1-122-505, -508 and -510) were converted into IgG constructs and expressed in COS cells with pairing ABT2-108 heavy chain. None of these clones showed improvements in IL-1α neutralization potency. Mutations from ABT1-122-505 and -508 were subsequently combined and produced the ABT1-122-511 clone. This clone, when converted into IgG with several of the improved anti-IL-1β ABT2-108 heavy chains showed improvements in its IL-1α neutralization potency by 4 to 5 folds. Representative IC50 data for ABT2-108/1-122-511 IgG is described in Table 9.

ABT2-108 CDR Recombination

Analysis of the round 2 outputs of the 2-108 CDR recombination clones is shown in Table 17. ABT2-108-601 was the dominant CDR1 sequence seen, and ABT2-108-612 was the most frequent CDR3 sequence observed. CDR2 sequences in the output showed more diversity, with ABT2-108-605 being represented the most. Based on these data, ABT2-108-620x (601-605-612) was converted in IgG with ABT1-122 and ABT1-122-511 light chains and tested in MRC-5 assays. Both pairs of ABT2-108-620x showed IL-1β neutralization potencies in the low pM range (see Table 18 below).

TABLE 17

ABT2-108 CDR recombination library R2 sorting outputs

| 1-122 Paired Library | 1-122-511 Paired Library |
|---|---|
| 0.5 nM Sort, R2 CDR1-CDR2-CDR3 | 0.5 nM Sort, R2 CDR1-CDR2-CDR3 |
| 601-WT-612 | 601-WT-612, 3x |
| 601-605-612 | 601-605-612 |
| 601-606-612 | 601-607-612 |
| 601-608-612 | 601-605-616 |
| 601-609-612 | 601-605-617 |
| 601-605-613 | 601-605-WT |
| 601-605-616 | |
| 601-607-616 | |
| 0.25 nM Sort, R2 | 0.25 nM Sort, R2 |
| WT-605-612 | 601-WT-612, 2x |
| 601-609-612 | 601-605-612, 2x |
| 601-606-612 | |
| 601-605-616 | |

TABLE 18

MRC-5 IL-1β neutralization potencies

| Clone numbers | % Inhibition |
|---|---|
| 2-108/1-122 | ~15 nM |
| 2-108-605/1-122 | ~0.35 nM |
| 2-108-612/1-122 | ~0.45 |
| 2-108/1-122-511 | ~8 nM |
| 2-108-620x/1-122 | ~0.05 nM |
| 2-108-620x/1-122-511 | ~0.03 nM |
| MAB201 | ~0.004 nM |

In conclusion, the above example demonstrates the feasibility of affinity maturation of dual-specific antibody by a newly developed Fab expression system on the surface of yeast cells. ABT2-108 dAb was affinity matured by at least 20-100 fold in this Fab expression system. This finding is consistent with that observed by the well established scFv yeast display system described above in Examples 2.2, as similarly improved clones were identified by both approaches.

The identification of improvement clones in the ABT1-122 individual CDR affinity maturation did not occur with the Fab expression system, although this was also observed by a parallel scFv approach (data not shown). The combination of two single amino acid changes in CDR2 and CDR3, however, resulted in an ABT1-122-511 clone with 4-5 fold improved neutralization potency as compared with parental ABT1-122 clone.

Thus, the results showed that domain antibodies can be affinity matured, and, furthermore, that yeast Fab display system can be used for their affinity maturation.

Example 3

Summary of dAbs

A summary of the domain antibodies with advantageous neutralizing and affinity characteristics, i.e., dAbs with these properties identified in the library screen and subjected to affinity maturation processes described above, is provided in Table 61 and in Table 19 below. For each clone described herein, the first part its name relates to its specificity (IL-1α represented by ABT1; and IL-1β represented by ABT2).

TABLE 19

Summary of lead dAb molecules

| Clone Name | Clone type | Specificity | MRC5 ND$_{10}$ | MRC5 ND$_{50}$ |
|---|---|---|---|---|
| ABT1-6-23 | VH (3.5G VH3) | IL-1α | 3 nM | 30 nM |
| ABT1-86 | VH (4G H17) | IL-1α | <200 nM | 900 nM |
| ABT1-95 | VK (4G K) | IL-1α | 150 nM | 700 nM |
| ABT1-96 | VH (4G H15) | IL-1α | 3 nM | 11 nM |
| ABT1-98 | VH (4G H11) | IL-1α | 10 nM | 30 nM |
| ABT1-122 | VK (4G K) | IL-1α | 9 nM | 50 nM |
| ABT1-141 | VK (4G K) | IL-1α | 10 nM | 70 nM |
| ABT2-13 | VH (4G H11) | IL-1β | 100 nM | 800 nM |
| ABT2-42 | VK (4G K) | IL-1β | 100 nM | 770 nM |
| ABT2-46 | VK (4G K) | IL-1β | 70 nM | 386 nM |
| ABT2-65 | VH (4G H18) | IL-1β | 100 nM | 266 nM |
| ABT2-76 | VK (4G K) | IL-1β | 50 nM | 456 nM |
| ABT2-108 | VH (4G H17) | IL-1β | 150 nM | 250 nM |

Detailed information regarding each of the identified IL-1α and IL-1β antibodies having advantageous neutralizing and affinity characteristics is also provided below:

A. Domain Antibody: ABT1-6-23

Library: 3.5G VH3

Amino Acid Sequence: (diversified residues are indicated in bold; the CDRs are underlined)

EVQLLESGGGLVQPGGSLRLSCAASGFTFVRYDMAWVRQAPGKGLEWVSS

IYKSGALTSYDSVKGRFTISRDNSKNTLYLQMNSLRAEDTAVYYCAKGWA

SFDYWGQGTLVTVSS (SEQ ID NO: 4)

Clone ABT1-6-23 is an affinity matured variant; created by combining CDR1 from ABT1-6-15 with CDR2 from ABT1-6-3 (these three clones are all affinity matured derivatives of the parental clone ABT1-6). The CDR3 for all three affinity matured clones is unchanged from the parental clone ABT1-6. The CDR amino acid sequences are detailed in Table 20.

TABLE 20

Summary of the CDR differences between the parental ABT1-6 clone and the affinity matured progeny. Amino acid differences from the parental clone are in bold and underlined text ("CDR1" sequences disclosed as SEQ ID NOS 1290, 1290, 1 and 1, "CDR2" sequences disclosed as sequences disclosed as SEQ ID NOS 1291, 2, 1291 and 2 and all "CDR3" sequences disclosed as SEQ ID NO: 3, all respectively, in order of appearance)

| | CDR1 | CDR2 | CDR3 | MRC5 ND50 |
|---|---|---|---|---|
| ABT1-6 | GAYDMQ | SINKSGALTSYDSVKG | GWASFDY | 15 μM |
| ABT1-6-3 | GAYDMQ | SIYKSGALTSYDSVKG | GWASFDY | 0.08 μM |

TABLE 20-continued

Summary of the CDR differences between the parental ABT1-6 clone and the affinity matured progeny. Amino acid differences from the parental clone are in bold and underlined text ("CDR1" sequences disclosed as SEQ ID NOS 1290, 1290, 1 and 1, "CDR2" sequences disclosed as sequences disclosed as SEQ ID NOS 1291, 2, 1291 and 2 and all "CDR3" sequences disclosed as SEQ ID NO: 3, all respectively, in order of appearance)

| | CDR1 | CDR2 | CDR3 | MRC5 ND50 |
|---|---|---|---|---|
| ABT1-6-15 | VRYDMA | SINKSGALTSYDSVKG | GWASFDY | 2 μM |
| ABT1-6-23 | VRYDMA | SIYKSGALTSYDSVKG | GWASFDY | 0.03 μM |

Amino acid differences from the parental clone are in bold and underlined text.

Calculated MW: 12565 Da
MRC5 $ND_{50}$: 30 nM
Specificity: IL-1α.
No significant inhibition by other human or murine IL-1 family members including IL-1β, IL-1 receptor antagonist, IL-18, or human TNF.
BIAcore Kinetic Analysis: The calculated kinetic dissociation constant ($K_D$), association rate constant ($k_a$) and dissociation rate constant ($k_d$) are summarized in Table 21.

TABLE 21

| Kinetic constants determined by BIAcore analysis | | | |
|---|---|---|---|
| $k_a$ (M·s$^{-1}$) | $k_d$ (s$^{-1}$) | $K_D$ (M) | $\chi^2$ |
| $2.0 \times 10^5$ | $1.2 \times 10^{-2}$ | $6.1 \times 10^{-8}$ | 1.94 |

B. Domain Antibody: ABT1-86
Library: 4G H17
Amino Acid Sequence: (diversified residues are indicated in bold; the CDRs are underlined. A single K to E framework 3 mutation is highlighted in parentheses)

EVQLLESGGGLVQPGGSLRLSCAASGFTFDRYIMAWVRQAPGKGLEWVSS

ITPSGAATYYADSVKGRFTISRDNSKNTLYLQMNSLRAEDTAVYYCA (E) EPADRYSTWTFDYWGQGTLVTVSS (SEQ ID NO: 8)

Calculated MW: 13398 Da
MRC5 $ND_{50}$: 900 nM
Specificity: IL-1α.
No significant inhibition by other human or murine IL-1 family members including IL-1β, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarized in Table 22.

TABLE 22

| Kinetic constants determined by BIAcore analysis | | | |
|---|---|---|---|
| $k_a$ (M·s$^{-1}$) | $k_d$ (s$^{-1}$) | $K_D$ (M) | $\chi^2$ |
| $8.2 \times 10^5$ | $9 \times 10^{-2}$ | $1.1 \times 10^{-7}$ | 0.03 |

C. Domain Antibody: ABT1-95
Library: 4G K
Amino Acid Sequence: (diversified residues are indicated in bold; the CDRs are underlined)

DIQMTQSPSSLSASVGDRVTITCRASQPIHGNLRWYQQKPGKAPKLLIYN

ISNLQSGVPSRFSGSGSGTDFTLTISSLQPEDFATYYCQQGYRWPVTFGQ

GTKVEIKR (SEQ ID NO: 12)

Calculated MW: 11930 Da
MRC5 $ND_{50}$: 800 nM
Specificity: IL-1α.
No significant inhibition by other human or murine IL-1 family members including IL-1β, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 23.

TABLE 23

| Kinetic constants determined by BIAcore analysis | | | |
|---|---|---|---|
| $k_a$ (M·s$^{-1}$) | $k_d$ (s$^{-1}$) | $K_D$ (M) | $\chi^2$ |
| $4.9 \times 10^5$ | $2.2 \times 10^{-2}$ | $4.5 \times 10^{-8}$ | 0.13 |

D. Domain Antibody: ABT1-96
Library: 4G H15
Amino Acid Sequence: (diversified residues are indicated in bold; the CDRs are underlined)

EVQLLESGGGLVQPGGSLRLSCAASGFTFNQYNMFWVRQAPGKGLEWVSV

ISGSGRPTYADSVKGRFTISRDNSKNTLYLQMNSLRAEDTAVYYCAKGWW

RRDPPFDYWGQGTLVTVSS (SEQ ID NO: 16)

Calculated MW: 13408 Da
MRC5 $ND_{50}$: 11 nM
Specificity: IL-1α.
No significant inhibition by other human or murine IL-1 family members including IL-1β, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 24.

TABLE 24

| Kinetic constants determined by BIAcore analysis | | | |
|---|---|---|---|
| $k_a$ (M·s$^{-1}$) | $k_d$ (s$^{-1}$) | $K_D$ (M) | $\chi^2$ |
| $3.7 \times 10^5$ | $3.9 \times 10^{-4}$ | $1.1 \times 10^{-9}$ | 0.8 |

E. Domain Antibody: ABT1-98
Library: 4G H11
Amino Acid Sequence: (diversified residues are indicated in bold; the CDRs are underlined)

EVQLLESGGGLVQPGGSLRLSCAASGFTFDGYIMSWVRQAPGKGLEWVS

TISPLGSVTYYADSVKGRFTISRDNSKNTLYLQMNSLRAEDTAVYYCAK

KGPWFDYWGQGTLVTVSS (SEQ ID NO: 20)

Calculated MW: 12645 Da
MRC5 $ND_{50}$: 30 nM
Specificity: IL-1α.
No significant inhibition by other human or murine IL-1 family members including IL-1β, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 25.

TABLE 25

Kinetic constants determined by BIAcore analysis

| $k_a$ (M·s$^{-1}$) | $k_d$ (s$^{-1}$) | $K_D$ (M) | $\chi^2$ |
|---|---|---|---|
| 2.0 × 10$^6$ | 2.7 × 10$^{-2}$ | 1.3 × 10$^{-8}$ | 7.9 |

F. Domain Antibody: ABT1-122
Library: 4G K
Amino Acid Sequence: (diversified residues are indicated in bold; the CDRs are underlined)

DIQMTQSPSSLSASVGDRVTITCRASQPIWTELNWYQQKPGKAPKLLIY

GSSSLQSGVPRFSGSGSGTDFTLTISSLQPEDFATYYCQQFAYFPATFGQ

GTKVEIKR (SEQ ID NO: 24)

Calculated MW: 11824 Da
MRC5 $ND_{50}$: 50 nM
Specificity: IL-1α.
No significant inhibition by other human or murine IL-1 family members including IL-1β, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 26.

TABLE 26

Kinetic constants determined by BIAcore analysis

| $k_a$ (M·s$^{-1}$) | $k_d$ (s$^{-1}$) | $K_D$ (M) | $\chi^2$ |
|---|---|---|---|
| 6.6 × 10$^6$ | 0.28 | 4.2 × 10$^{-8}$ | 2.4 |

G. Domain Antibody: ABT1-141
Library: 4G K
Amino Acid Sequence: (diversified residues are indicated in bold the CDRs are underlined)

DIQMTQSPSSLSASVGDRVTITCRASQWIQKQLAWYQQKPGKAPKLLIY

SSSYLQSGVPRFSGSGSGTDFTLTISSLQPEDFATYYCQQHLRVPFTFG

QGTKVEIKR (SEQ ID NO: 28)

Calculated MW: 11998 Da
MRC5 $ND_{50}$: 50 nM
Specificity: IL-1α.
No significant inhibition by other human or murine IL-1 family members or human TNF.
BIAcore Kinetic Analysis:
The calculated kinetic dissociation constant ($K_D$), association rate constant ($k_a$) and dissociation rate constant ($k_d$) are summarised in Table 27.

TABLE 27

Kinetic constants determined by BIAcore analysis

| $k_a$ (M·s$^{-1}$) | $k_d$ (s$^{-1}$) | $K_D$ (M) | $\chi^2$ |
|---|---|---|---|
| 1.3 × 10$^4$ | 3.9 × 10$^{-3}$ | 3.0 × 10$^{-7}$ | 5.7 |

H. Domain Antibody: ABT2-13
Library: 4G H11
Amino Acid Sequence: (diversified residues are indicated in bold; the CDRs are underlined. A single V to A framework 2 mutation is highlighted in parentheses)

EVQLLESGGGLVQPGGSLRLSCAASGFTFRDYVMYW(A)RQAPGKGLEWV

SRIDPMGSSTYYADSVKGRFTISRDNSKNTLYLQMNSLRAEDTAVYYCAK

PEGNFDYWGQGTLVTVSS (SEQ ID NO: 32)

Calculated MW: 12796 Da
MRC5 $ND_{50}$: ~1000 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarise in Table 28.

TABLE 28

Kinetic constants determined by BIAcore analysis

| $k_a$ (M·s$^{-1}$) | $k_d$ (s$^{-1}$) | $K_D$ (M) | $\chi^2$ |
|---|---|---|---|
| 8.1 × 10$^4$ | 7.5 × 10$^{-2}$ | 9.3 × 10$^{-7}$ | 0.03 |

I. Domain Antibody: ABT2-42
Library: 4G K
Amino Acid Sequence: (diversified residues are indicated in bold; the CDRs are underlined. A single K to T framework 2 mutation is highlighted in parentheses)

DIQMTQSPSSLSASVGDRVTITCRASQYIEKWLTWYQQKPGKAP(T)LLI

YRGSLLQSGVPRFSGSGSGTDFTLTISSLQPEDFATYYCQQTEYWPFTFG

QGTKVEIKR (SEQ ID NO: 36)

Calculated MW: 12100 Da
MRC5 $ND_{50}$: 770 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 29.

TABLE 29

Kinetic constants determined by BIAcore analysis

| $k_a$ (M·s$^{-1}$) | $k_d$ (s$^{-1}$) | $K_D$ (M) | $\chi^2$ |
|---|---|---|---|
| 2.5 × 10$^3$ | 0.13 | 5.4 × 10$^{-5}$ | 0.02 |

J. Domain Antibody: ABT2-46
Library: 4G K
Amino Acid Sequence: (diversified residues are indicated in bold; the CDRs are underlined)

DIQMTQSPSSLSASVGDRVTITC<u>RASQSIIEWLS</u>WYQQKPGKAPKLLIY

<u>RTSVL</u>QSGVPSRFSGSGSGTDFTLTISSLQPEDFATYYC<u>QQNEFWPFT</u>

FGQGTKVEIKR (SEQ ID NO: 40)

Calculated MW: 12049 Da
MRC5 $ND_{50}$: 386 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 30.

TABLE 30

| Kinetic constants determined by BIAcore analysis | | | |
|---|---|---|---|
| $k_a (M \cdot s^{-1})$ | $k_d (s^{-1})$ | $K_D (M)$ | $\chi^2$ |
| $2.3 \times 10^4$ | $6.3 \times 10^{-2}$ | $2.8 \times 10^{-6}$ | 0.04 |

K. Domain Antibody: ABT2-65
Library: 4G H18
Amino Acid Sequence: (diversified residues are indicated in bold; the CDRs are underlined. A single N to D framework 3 mutation is highlighted in parentheses).

EVQLLESGGGLVQPGGSLRLSCAASGFTF<u>EDYQMG</u>WVRQAPGKGLEWV

S<u>SISAMGNRTYY</u>ADSVKGRFTISRD(D)SKNTLYLQMNSLRAEDTAVYY

CAK<u>NLVRTQSKMWMFDY</u>WGQGTLVTVSS (SEQ ID NO: 44)

Calculated MW: 13672 Da
MRC5 $ND_{50}$: 266 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarise in Table 31.

TABLE 31

| Kinetic constants determined by BIAcore analysis | | | |
|---|---|---|---|
| $k_a (M \cdot s^{-1})$ | $k_d (s^{-1})$ | $K_D (M)$ | $\chi^2$ |
| $2.5 \times 10^5$ | $2.0 \times 10^{-2}$ | $9.7 \times 10^{-8}$ | 0.32 |

L. Domain Antibody: ABT2-76
Library: 4G K
Amino Acid Sequence: (diversified residues are indicated in bold; the CDRs are underlined)

DIQMTQSPSSLSASVGDRVTITC<u>RASQSIDRWLA</u>WYQQKPGKAPKLLIY

<u>RGSIL</u>QSGVPSRFSGSGSGTDFTLTISSLQPEDFATYYC<u>QQVAFWPPT</u>

FGQGTKVEIKR (SEQ ID NO: 48)

Calculated MW: 11908 Da
MRC5 $ND_{50}$: 456 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarise in Table 32.

TABLE 32

| Kinetic constants determined by BIAcore analysis | | | |
|---|---|---|---|
| $k_a (M \cdot s^{-1})$ | $k_d (s^{-1})$ | $K_D (M)$ | $\chi^2$ |
| $2.0 \times 10^4$ | $2.7 \times 10^{-2}$ | $1.3 \times 10^{-6}$ | 0.99 |

M. Domain Antibody: ABT2-108
Library: 4G H17
Amino Acid Sequence: (diversified residues are indicated in bold: the CDRs are underlined)

EVQLLESGGGLVQPGGSLRLSCAASGFTF<u>AEYTMM</u>WVRQAPGKGLEWV

S<u>RIGQDGKNTYY</u>ADSVKGRFTISRDNSKNTLYLQMNSLRAEDTAVYYCA

K<u>YTGRVGVHHLFDY</u>WGQGTLVTSS (SEQ ID NO: 52)

Calculated MW: 13471 Da
MRC5 $ND_{50}$: 200 nM
Specificity: IL-1β.
No significant inhibition by other human or murine IL-1 family members including IL-1α, IL-1 receptor antagonist, IL-18, or human TNF.
BIAcore Kinetic Analysis:
The calculated kinetic dissociation constant ($K_D$), association rate constant ($k_a$) and dissociation rate constant ($k_d$) are summarised in Table 33.

TABLE 33

| Kinetic constants determined by BIAcore analysis | | | |
|---|---|---|---|
| $k_a (M \cdot s^{-1})$ | $k_d (s^{-1})$ | $K_D (M)$ | $\chi^2$ |
| $2.9 \times 10^4$ | $3.1 \times 10^{-3}$ | $1.1 \times 10^{-7}$ | 0.06 |

Tables 62 and 63 provide an overview of the characteristics of the IL-1α (ABT1) dAbs and IL-1β dAbs, respectively. In addition, the sequences of all of the dAb variable heavy and light chains identified herein are provided in Table 64.

Example 4

Construction of Expression Vectors (P-Ef-Bos) for Recombinant Antibody Expression A panel of expression vectors, also referred to herein as master template plasmids or master templates, for the expression of recombinant human and mouse IgG were constructed from pre-existing antibody constructs. The purpose of making these master templates was to generate a panel of improved expression vectors, i.e., improved pEF-BOS-based cloning vectors, for mammalian expression of recombinant human and mouse IgGs in transiently transfected COS cells. The pEF-BOS vector was originally described in Mizushima and Nagata, pEF-BOS, a powerful mammalian expression vector. Nucleic Acids Res, 1990. 18(17): p. 5322.

The constructed mammalian expression vectors described herein, all have a 1-kb stuffer sequence in between an upstream signal peptide leader sequence and a downstream Ig constant region sequence. In order to make an antibody heavy or light chain construct, the stuffer sequence in the chosen master template is removed by restriction enzyme digestion followed by inserting the desired antibody V domain sequence (VH, Vκ, or Vγ). The resulting plasmid constructs are easily propriated in and purified from *E. coli* and can be used to express antibody by co-transfecting both a heavy chain and a light chain construct in COS cells.

Mouse Master Template Constructions

Master templates for mouse IgGs were constructed by first introducing both FspA I and Afe I sites in between the signal peptide leader sequences and the constant regions and subclone the amplified products into the Srf I and Not I sites of pEF-BOS vector backbone. The four primers used for pBOS-mCκ overlapping PCR were pEF-BOS-Fwd, mCkappa-Rev, mCkappa-Fwd, and pEF-BOS-Rev using pA534 and pA246 DNA as templates. For pBOS-mCγ1, the primers were pEF-BOS-Fwd, mIgG1-Rev, mIgG1-Fwd, pEF-BOS-Rev and the templates was pA245. Similarly, the primers for pBOS-mCγ2a were pEF-BOS-Fwd, mIgG2a-Rev, mIgG2a-Fwd, and pEF-BOS-Rev using templates pA245 and pA239. After the first step, a blunt-end stuffer sequence, which was amplified by LambdaStuffer-Fwd and -Rev primers from λ/Hind III digested DNA markers, was inserted into these constructs linearized by FspA I and Afe I to create the final mouse master templates.

Human Master Template Constructions

Human heavy chain master templates were constructed by one of two methods. For pBOS-hCγ1,z,non-a and pBOS-hCγ1,z,non-a,mut(234,235) constructs, a heavy chain leader sequence was linked to the stuffer sequence by overlapping PCR using primers pEF-BOS-Fwd, SHS-Rev, SHS-Fwd, and hCGamma1-Rev and the template vectors. The resulting PCR products were than inserted into pBOS backbone vectors, via Srf I and Sal I sites. For pBOS-hCγ1,z,non-a,mut(234,237), a stuffer sequence was amplified by SHS-Fwd and hCGamma1-Rev primers, digested by Sal I, and subcloned into Nru I and Sal I-digested vector. The pBOS-hCγ1,z,a, pBOS-hCγ4, and pBOS-hCγ2(n−) were made by subcloning the Sal I and Not I digested constant regions from constant chain containing vectors, and an RT-PCR product from transiently transfected COS cells expressing IgG2 into pBOS-hCγ1,z,non-a,mut(234,237) linearized by Sal I and Not I.

For the pBOS-hCγ2, (n+) construct, a GVE to GME amino acid change was introduced into the IgG2 Fc region in the pBOSAB198G2WT template via overlapping PCR using primers 5'Sal198, 3Sal198, 5'GME198, and 3'BSR198. Product from this overlapping PCR served as template for the next round of overlapping PCR to introduce a PSS to TSS amino acid change in the IgG2 Fc region using primers 5'Sal198, 3'TSS198, 5'BSR198, and 3'BSR198. This PCR product was then inserted back into the pBOSAB198G2WT via BsrG I and Sal I sites. Finally, the IgG2(n+) constant region from this vector was excised and inserted into pBOS-hCγ2(n−) via Sal I and Not I sites to generate the pBOS-hCγ2(n+) construct.

Using pEF-BOS-Fwd, SLS-Rev, SLS-Fwd, hCkappa-Rev2, hCkappa-Fwd2, and pEF-BOS-Rev primers and DNA templates, the human κ light chain master template was made by two overlapping PCRs linking a κ leader sequence to the stuffer sequence then to the human κ constant region before cloning the final product into Srf I and Not I-lineared pEF-BOS-based backbone.

Similarly, for pBOS-hCλ master template construction, primers pEF-BOS-Fwd, LambdaSignal-Rev, LambdaSignal-Fwd, hCLambda-Rev, hCLambda-fwd and pEF-BOS-Rev were used to amplify λ light chain leader sequence, the stuffer sequence, and human λ light chain constant region sequence together using templates in two overlapping PCRS. The final product was cloned into Srf I and Not I-lineared pEF-BOS-based backbone. PCR primers used in the construction of the vectors are described in Table 34.

TABLE 34

PCR primers used in constructing pEF-BOS master templates

| Name | Oligo Sequence | SEQ ID NO: |
|---|---|---|
| StufferLightSignal (SLS)-Rev | TCGGCATACCATGCGCATCGCGAGCCGGGGAACCAC | 1099 |
| StufferLightSignal (SLS)-Fwd | CGATGCGCATGGTATGCCGAAAGGGATGC | 1100 |
| StufferHeavySignal (SHS)-Rev | GCACTGGACACCTTTTAAAATCGCG | 1101 |
| StufferHeavySignal (SHS)-Fwd | CGATTTTAAAAGGTGTCCAGTGCGCATGGTATGCCGAAAGGGATGC | 1102 |
| pEF-BOS-Rev | GGAGACCTGATACTCTCAAG | 1103 |
| pEF-BOS-Fwd | TCAGGTGTCGTGAGGAAT | 1104 |
| mIgG2a-Rev | GTTTTAGCGCTACACTGGACACCTTTTAAAATCGCG | 1105 |
| mIgG2a-Fwd | GGTGTCCAGTGTAGCGCTAAAACAACAGCCCCATCG | 1106 |
| mIgG1-Rev | CGTTTTAGCGCTACACTGGACACCTTTTAAAATCG | 1107 |
| mIgG1-Fwd | GGTGTCCAGTGTAGCGCTAAAACGACACCCCCATC | 1108 |

TABLE 34-continued

PCR primers used in constructing pEF-BOS master templates

| Name | Oligo Sequence | SEQ ID NO: |
|---|---|---|
| mCkappa-Rev | GCAGCATCAGCGCTGCATCGCGAGCCGGGGAACCAC | 1109 |
| mCkappa-Fwd | GGCTCGCGATGCAGCGCTGATGCTGCACCAACTG | 1110 |
| LambdaStuffer-Rev | GCTTGTCACCCAGGAACG | 1111 |
| LambdaStuffer-Fwd | CGAAAGGGATGCTGAAATTGAG | 1112 |
| LambdaSignal-Rev | CATCCCTTTCGCGATAAGCTTCCTGTGCAG | 1113 |
| LambdaSignal-Fwd | GAAGCTTATCGCGAAAGGGATGCTGAAATTGAG | 1114 |
| hCLambda-Rev | GCCTTGGGTTAACGCTTGTCACCCAGGAACG | 1115 |
| hCLambda-Fwd | GGTGACAAGCGTTAACCCAAGGCTGCCCCCTCGGTC | 1116 |
| hCkappa-Rev2 | CAGCCACCGTACGTAGCTTGTCACCCAGGAACG | 1117 |
| hCkappa-Fwd2 | GTGACAAGCTACGTACGGTGGCTGCACCATCTG | 1118 |
| hCGamma1-Rev | CTTGGTCGACGCGCTTGTCACCCAGGAACG | 1119 |
| hCGamma1-Fwd | GGTGACAAGCGCGTCGACCAAGGGCCCATCGGTC | 1120 |
| 5'Sal198 | TCTACGACTACGGTATGGACGTCTGG | 1121 |
| 3'Sal198 | GCCGTCCACGTACCAGTTGAAC | 1122 |
| 5'BSR198 | CCTCCAGCAACTTCGGCACCCAGACCTAC | 1123 |
| 3'BSR198 | ACCTGGTTCTTGGTCATCTCCTCCC | 1124 |
| 5'GME198 | GTTCAACTGGTACGTGGACGGCATGGAGGTG | 1125 |
| 3'TSS198 | GTAGGTCTGGGTGCCGAAGTTGCTGGAGGTCACGGTCAC | 1126 |

Condition for DNA Amplification by PCR

All PCRs were carried out in an MJ Research DNA engine tetrad 2 thermal cycler equipped with stainless steel heating blocks. The proofreading Pfu Turbo Hotstart DNA polymerase (Stratagene) and its accompanying buffer were used for DNA amplification to minimize undesired sequence mutation and generate blunt-ended products. Typical thermal cycling condition was an initial DNA template denaturation at 94° C. for 2 minutes; followed by 30 thermal cycles of 94° C. for 20 seconds, 55° C. for 20 seconds, and 72° C. for 1 minute per kb; finished up by an additional 5 minutes at 72° C. and kept at 4° C. forever.

Sequencing Confirmation

All constructed master templates were sequenced and confirmed in the region between the Srf I and Not I cloning sites using primers pEF-BOS-Fwd, pEF-BOS-Rev, and Lambda844. Twenty two additional primers as listed in Table 35 were used to obtain the vector backbone sequence in both DNA strands of pBOS-mCκ. This sequence was then applied to all master templates for their electronic DNA sequence files by Vector NTI software package.

TABLE 35

Sequencing primers for pEF-BOS vector backbone

| Name | Oligo Sequence | SEQ ID NO: |
|---|---|---|
| Lambda844 | AAGCGTTTCACTAATGGGCG | 1127 |
| F1042 | ATAAGCGGCCGCGACTCTAGAG | 1128 |
| F1541 | TCACCCTCCACCTCTTCACC | 1129 |
| F2058 | GGACTCCAACGTCAAAGGG | 1130 |
| F2538 | AAACGCGCGAGACGAAAGG | 1131 |
| F3071 | AAAGCATCTTACGGATGG | 1132 |
| F3553 | ATGAACGAAATAGACAGATCGC | 1133 |
| F4068 | TTACCGGATAAGGCGCAG | 1134 |
| F4557 | ATACGCAAACCGCCTCTC | 1135 |
| F5060 | TTGCAGCTAATGGACCTTCTAG | 1136 |
| F5551 | AATCTGGTGGCACCTTCGCG | 1137 |

TABLE 35-continued

Sequencing primers for pEF-BOS vector backbone

| Name | Oligo Sequence | SEQ ID NO: |
|---|---|---|
| F6068 | TTCTCGAGCTTTTGGAGTACG | 1138 |
| R1527 | GGGTGACAGTGGAGCTTCCT | 1139 |
| R2023 | ACTCTTGTTCCAAACTGG | 1140 |
| R2530 | TCTCGCGCGTTTCGGTGATG | 1141 |
| R3056 | TGCTTTTCTGTGACTGGTGAG | 1142 |
| R3535 | CATCCATAGTTGCCTGACTCC | 1143 |
| R4036 | TCCAACCCGGTAAGACACG | 1144 |
| R4552 | AGGCGGTTTGCGTATTGGGC | 1145 |
| R5051 | CCATTAGCTGCAAAGATTCCTC | 1146 |
| R5548 | AAGGTGCCACCAGATTCGC | 1147 |
| R6051 | GAACTAATCGAGGTGCCTGG | 1148 |
| R6300 | ATGGATCTCGAGGTCGAGGG | 1149 |

Results

Mouse Master Templates

Three mouse master templates were made: pBOS-mCκ, pBOS-mCγ1, and pBOS-mCγ2a. Sequences for the murine vectors are described in SEQ ID NOs 844 to 855 and provided in Table 36.

TABLE 36

Table of sequences and corresponding vectors

| SEQ ID NO | VECTOR NAME and CONSTANT REGION (constant region and stuffer sequences indicated) |
|---|---|
| 855 | pBOS-hCg1, z, a- (Constant region nt 1101 to 2093; stuffer sequence nt 124-1103) |
| 844 | pBOS-hCg1, z, non-a, mut (234, 235) (Constant region nt 1101 to 2093; stuffer sequence nt 124-1100) |
| 845 | pBOS-hCg1, z, non-a, mut (234, 237) (Constant region nt 1101 to 2093; stuffer sequence nt 124-1100) |
| 846 | pBOS-hCg1, z, non-a (Constant region nt 1101 to 2093; stuffer sequence nt 124-1100) |
| 847 | pBOS-hCg2, (n-) (Constant region nt 1101 to 2081; stuffer sequence nt 124-1100) |
| 848 | pBOS-hCg2, (n+) (Constant region nt 1101 to 2081; stuffer sequence nt 124-1100) |
| 849 | pBOS-hCg4 (Constant region nt 1101 to 2084; stuffer sequence nt 124-1100) |
| 850 | pBOS-hCk (Constant region nt 1114 to 1434; stuffer sequence nt 132-1100) |
| 851 | pBOS-hCl (Constant region nt 1095-1412; stuffer sequence nt 127-1095) |
| 852 | pBOS-mCg1 (Constant region nt 1101 to 2075; stuffer sequence nt 124-1100) |
| 853 | pBOS-mCg2a (Constant region nt 1101 to 2093; stuffer sequence nt 124-1100) |
| 854 | pBOS-mCk (Constant region nt 1109 to 1429; stuffer sequence nt 132-1108) |

The pBOS-mCκ may be used for cloning mouse Vκ region sequence for expressing a mouse Ig light chain, while pBOS-mCγ1 and pBOS-mCγ2a may be used for cloning mouse $V_H$ sequence for expressing a heavy chain with a γ1 and γ2a constant region, respectively. The 1-kb λ stuffer sequence in all three master templates can be released from the master template DNA by FspA I and Afe I (or Eco47 III) restriction enzymes. There is an Nru I site upstream of the FspA I site that can be used also. The resulting linearized vectors will have blunt ends at both 5' and 3' ends and are ready for ligation with blunt-ended V region sequences. If PCR amplification method is used to prepare the V region for subcloning, Pfu DNA polymerase or other DNA polymerases that produce blunt-end products should be used and the products need to be phosphorylated prior to ligating to the linearized and dephosphorylated pBOS vectors. Alternatively, bacterial homologous recombination can be used to subclone the desired V region into the pBOS master templates easily. For this approach, the V region amplification forward primer should have additional 30 nucleotides at the 5' end that overlaps with the 3' end of leader sequence in the vector, and the reverse primer should have additional 30 nucleotides at the 3' end that overlaps with the 5' end of the constant region sequence. After PCR amplification, the amplified V region products are gel-purified and mixed with the linearized vector DNA at greater than 5 to 1 molar ratio and co-transformed into a recombination-capable competent cells. The DH5α competent cells sold by Invitrogen work well for this purpose. A schematic showing the design and use of mouse pBOS templates is described in FIG. 18.

Human Master Templates

Table 37 lists the eight human pBOS master templates. The pBOS-hCκ template can be linearized by FspA I and BsiW I enzymes to remove the λ stuffer sequence and ligated to a Vκ sequence for kappa light chain expression (see FIG. 18B). Alternative 5' Nru 1 and 3' SnaB I restriction enzyme sites are available for cloning purpose if FapA I or BsiW I site is present in the Vκ sequence and thus prevents their use in cloning work. The pBOS-hCλ should be linearized by Nru I and Hpa I and ligated to Vλ sequence (FIG. 18B). Alternatively, the linearized vector can be homologously recombined with the Vλ sequence in bacteria as described in 5.1 to avoid the use of less efficient blunt-end ligation process or the presence of either Nru I or Hpa I site in the Vλ sequence. It should be noted that the creation of the Hpa I site at the 5' end of Cλ requires the creation of a C to T point mutation and this mutation must be corrected back to a C in the Vλ sequence to be ligated to the vector backbone. Keeping this mutation in the constructed plasmid will result in truncated open reading frame as the C to T mutation created a termination codon at the 5' end of Cλ.

All six human Ig heavy chain pBOS master templates can be used by the same cloning strategy. They all can be lineared by FspA I and Sal I restriction enzyme digestions and ligated to a VH sequence that has compatible ends (FIG. 18B). Again, there is an available Nru I site upstream of the FspA I site as an alternative cloning site.

TABLE 37

List of human pBOS master templates

| Template Name | Isotype | Allotype | Mutations |
|---|---|---|---|
| pBOS-hCκ | Kappa | | |
| pBOS-hCλ | Lambda | | |
| pBOS-hCγ1, z, a | Gamma1 | z, a | |
| pBOS-hCγ1, z, non-a | Gamma1 | z, non-a | |
| pBOS-hCγ1, z, non-a, mut(234, 235) | Gamma1 | z, non-a | a.a. 234 -> Ala, a.a. 235 -> Ala |
| pBOS-hCγ1, z, non-a, mut(234, 237) | Gamma1 | z, non-a | a.a. 234 -> Ala, a.a. 237 -> Ala |
| pBOS-hCγ2 (n-) | Gamma2 | n- | |
| pBOS-hCγ2 (n+) | Gamma2 | n+ | |
| pBOS-hCγ4 | Gamma4 | | | pEF-BOS Vector Backbone

The pBOS-mCκ was submitted for complete double-strand sequencing using primers listed in the methods section. A sequence contig was assembled and used as the template to generate all pBOS templates' electronic sequence file in Vector NTI program. Other than several single base-pair differences and difference in the length of a poly-A region, there was no major difference from the old pEF-BOS vector sequence. The new vector backbone sequence is a perfect match to the pUC119 plasmid sequence from which the pEF-BOS was derived (Mizushima and Nagata, pEF-BOS, a powerful mammalian expression vector. Nucleic Acids Res, 1990. 18(17): p. 5322).

The master templates described herein provide a 1-kb stuffer sequence unrelated to any Ig sequence in the vector. The 1-kb stuffer facilitates restriction enzyme digestion, easy removal by gel purification, and identifying correct clones from background colonies after transformation by either colony PCR or restriction digestion of miniprep DNAs.

Example 5

Expression of Paired Single Domain Antibodies as a Functional IL-1α and IL-1β Dual-Specific Molecule The overall objective of the study was to generate a dual-specific antibody that can bind and neutralize both IL-1α and β. Previous studies combined separate VH or VL dAbs with affinities for either IL-1α or IL-1β into a dual-specific IgG or IgG-like molecule that binds and neutralizes both IL-1α and β. Initial attempts to pair VH/VH or VL/VL to generate IgG-like proteins had poor yields and unpaired heavy/light chains using a COS cell expression system. This example provides an alternative format for expressing VH/VH or VL/VL single chain-Fc fusion proteins by directly pairing two dAbs with an inflexible linker and fused to a human IgG1 Fc region.

The purpose of the study was to determine if scFv-Fc fusion constructs could be made by linking an IL-1α and an IL-1β-specific VH dAb together, and if these constructs could maintain high neutralization potencies for both IL-1α and IL-1β in a bioassay. Constructs pairing ABT2-108-538x (an IL-1β specific VH dAb) with ABT1-207 or ABT1-98 (IL-1α specific VH dabs) were generated and analyzed to test this approach.

Materials and Methods

Figure 19:
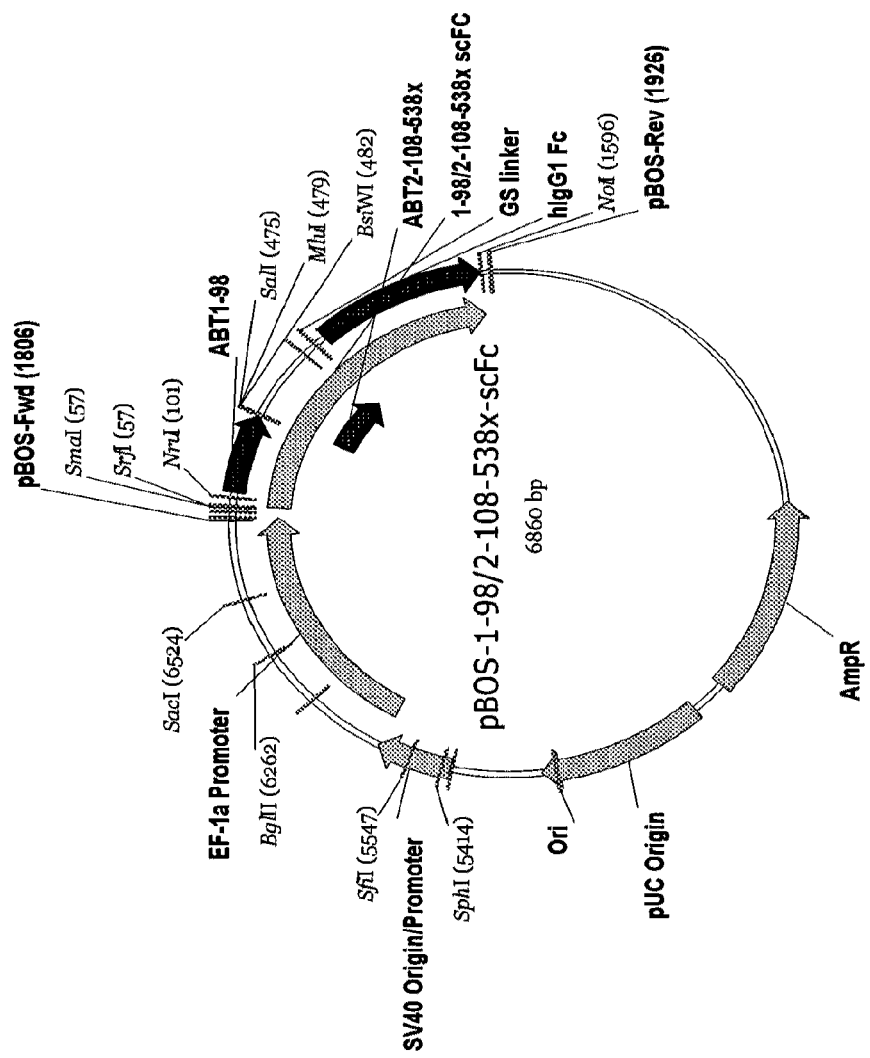
FIG. 19 describes a representative plasmid map of an scFv fusion construct (pBOS-1-98/2-108-538x-scFc).
Figure 20:
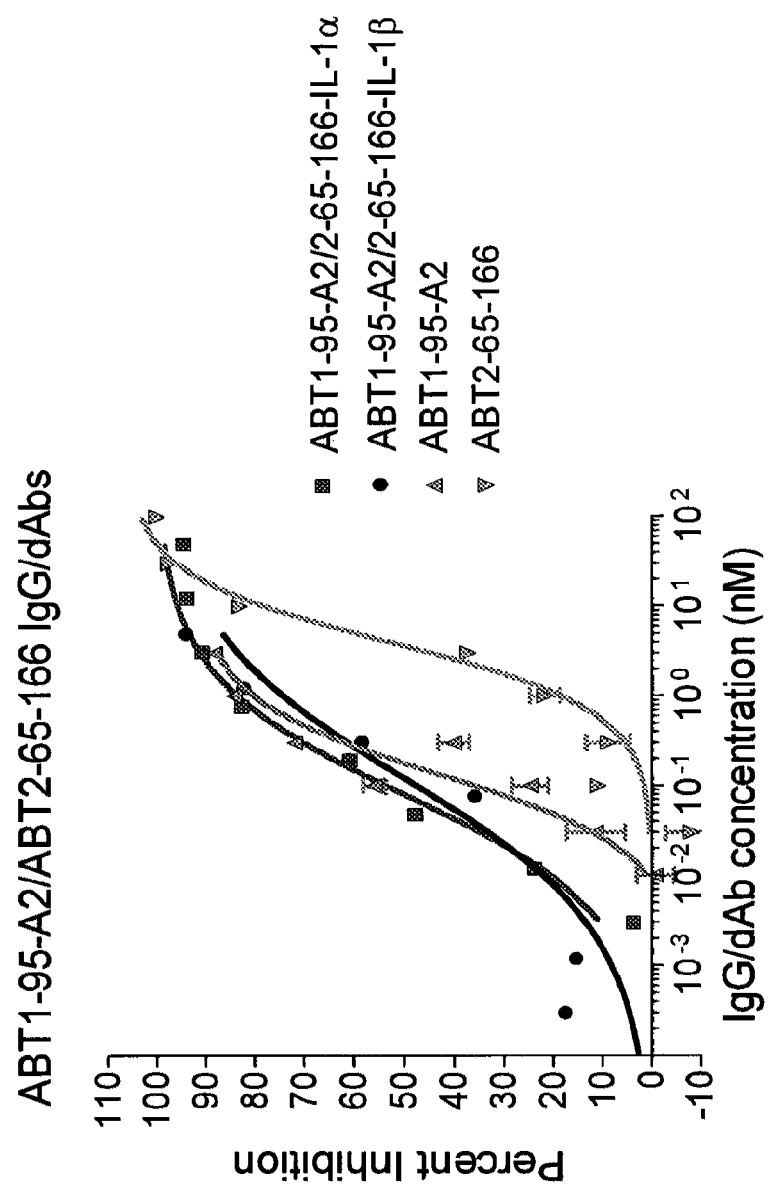
FIG. 20 shows combined MRC5 neutralisation data for IL-1α and IL-1β of the ABT1-95-A2 and ABT2-65-166 dAb molecules and the IgG resulting from the combination of these two dAb variable domains.

VH dAbs ABT2-108-538, ABT1-207, ABT1-98 were amplified from their corresponding pBOS plasmid constructs via PCR using primers SCFCVH 5' and GSBAMVH 3', resulting in the addition of a 3' (Gly$_4$Ser)$_3$ linker (SEQ ID NO: 1150), and gel purified. The Fc region was amplified from pBOS-hCg1,z, non-a via PCR using primers FCBAMB 5' and 1926 3', resulting in the addition of an overlapping 5' (Gly$_4$Ser)$_3$ linker (SEQ ID NO: 1150), and gel purified. Overlapping PCR using the purified VH-(Gly$_4$Ser)$_3$ (SEQ ID NO: 1150) and (Gly$_4$Ser)$_3$-FC PCR ("(Gly$_4$Ser)$_3$" disclosed as SEQ ID NO: 1150) products and primers SVFVH 5' and 1926 3' was performed, and the resulting products gel purified. The VH-FC fusions were inserted into vectors pBOS-ABT1-98, pBOS-ABT1-207, and pBOS-ABT2-108-538x via Not I and Sal I sites to generate constructs pBOS-1-98/2-108-538x-scFc, pBOS-1-207/2-108-538x-scFc, pBOS-2-108-538x/1-98-scFc, and pBOS-2-108-538x/1-207-scFc (FIG. 19). ScFc protein (scFc=ScFv-Fc fusion construct) for each construct was generated by transfecting the constructed plasmids into COS cells and purifying proteins using protein A column chromatography. The purified proteins were quantified by BCA assay using BSA as standard and also separated on reducing and non-reducing SDS-PAGE gels. Purified scFc proteins were tested for neutralization potencies against both IL-1α and IL-1β in MRC-5 assays.

TABLE 38

Primers used in PCR to generate scFc constructs

| Primer name | Sequence | SEQ ID NO: |
|---|---|---|
| SCFCVH 5' | Gactgcgtcgacgcgtacggaggtgcagctg ttggagtctggg | 1151 |
| GSBAMVH 3' | tccacctccaccggatccaccacctccgctc gagacggtgaccagggttccctg | 1152 |
| FCBAMB 5' | ggaggtggtggatccggtggaggtggatct ggtggtggtggatcacccaaatcttgtgac aaaactcacacatgccca | 1153 |
| 1926 3' | Ggagacctgatactctcaag | 1154 |

Results

The purified scFc protein for all 4 constructs produced well in COS cells, and gave one uniform band of slightly more than 100 kDa unreduced and 50 kDa reduced by SDS-PAGE. Protein yields are described below in Table 39.

TABLE 39

Protein yields of scFc constructs

| ScFc Construct | Protein yield (per L supernatant) |
|---|---|
| ABT1-98/2-108-538 | 6.2 mg |
| ABT1-207/2-108-538 | 4.6 mg |
| ABT2-108-538/1-98 | 4.4 mg |
| ABT2-108-538/1-207 | 1 mg |

Table 40 show the results of the MRC-5 assays, using MAB200 and MAB201 as reference antibodies, to measure IL-1α and β neutralization potencies of the scFc proteins

TABLE 40

Estimated EC50 for IL-1α and IL-β neutralization from MRC-5 assays

| Protein | IL-1α (nM) | IL-1β (nM) |
|---|---|---|
| ABT1-98/ABT2-108-538x | 30 | 1.3 |
| ABT1-207/ABT2-108-538x | 25 | 1.1 |
| ABT2-108-538x/ABT1-98 | 3 | <0.001 |
| ABT2-108-538x/ABT1-207 | 50 | 0.002 |
| MAB200 | 0.17 | — |
| MAB201 | — | 0.005 |

All scFc constructs generated showed neutralization for both IL-1α and β. The order of the VH dAbs in the scFc construct seemed to impact their neutralization potencies, however. For instance, ABT2-108-538x lost about 3 logs of potency against IL-1β when it was placed in between an N-terminal IL-1α dAb and a C-terminal Fc in the scFc construct than if it was placed N-terminal to both the IL-1α dAb and the Fc. The placement of the IL-1α dAb in the scFc construct seemed to have less impact on the neutralization potency. In the case of ABT1-98, it lost about one log of IL-1α neutralization potency going from the C-terminal to the N-terminal VH position in the scFc, whereas ABT1-207 lost about 2-fold potency going from the N-terminal to the C-terminal VH in the scFc construct with the IL-1β VH2-108-538x.

The scFv construct that showed the best neutralization potency for both IL-1α and β was ABT2-108-538x/ABT1-98, with EC50s of ~3 nM against IL-1α and less than 1 pM against IL-1β

Summary of Variable Domain Pairing and Neutralization Data

Table 41 describes 10 Fab molecules that were specific to IL-1α/IL-1β and were also able neutralizing in a standard MRC5 in vitro bioassay. In addition, Fab molecule ABT1-6-23/ABT2-13 was effective at neutralizing with respect to IL-1α, however the molecule was not been tested at a sufficient concentration to determine a value for IL-1β neutralisation. For each clone described herein, the first part its name relates to its specificity (IL-1α represented by ABT1; and IL-1β represented by ABT2).

TABLE 41

Summary of the most potent IL-1 neutralising dAb pairing as determined in the MRC5 bioassay. Clone ABT1-6-23 is an affinity matured clone derived from the parental ABT1-6.

| Fab pairing | dAb type | Fab IL-1α $ND_{10}$ | Fab IL-1β $ND_{10}$ |
|---|---|---|---|
| ABT1-96/ABT2-42 | VH/VK | 3 nM | 10 nM |
| ABT1-122/ABT2-108 | VK/VH | 3 nM | 50 nM |
| ABT1-141/ABT2-108 | VK/VH | 10 nM | 15 nM |
| ABT1-96/ABT2-13 | VH/VH | 0.9 nM | 80 nM |
| ABT1-6-23/ABT2-46 | VH/VK | 4 nM | 150 nM |
| ABT1-141/ABT2-65 | VK/VH | 80 nM | 300 nM |
| ABT1-96/ABT2-46 | VH/VK | 6 nM | 400 nM |
| ABT1-95/ABT2-13 | VK/VH | 200 nM | 400 nM |
| ABT1-122/ABT2-65 | VK/VH | 40 nM | 1500 nM |
| ABT1-98/ABT2-76 | VH/VK | 100 nM | 1500 nM |
| ABT1-6-23/ABT2-13 | VH/VH | 40 nM | >500 nM |

A summary of the IL-1α and IL-1β pairs is described in more detail below and is also described above in Table 9.

Pairing ABT1-122 with ABT2-108

The $ND_{10}$ and $ND_{50}$ values determined from the MRC5 IL-1α and IL-1β neutralisation assay data are summarised in Table 42.

TABLE 42

$ND_{50}$ and $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-122 | 9 nM | 50 nM | — | — |
| dAb ABT2-108 | — | — | 150 nM | 250 nM |
| Fab | 3 nM | 60 nM | 50 nM | 150 nM |

Pairing ABT1-141 with ABT2-108

The $ND_{10}$ and $ND_{50}$ values determined from the MRC5 IL-1α and IL-1β neutralisation assay data are summarised in Table 43.

TABLE 43

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-141 | 10 nM | 70 nM | — | — |
| dAb ABT2-108 | — | — | 150 nM | 250 nM |
| Fab | 10 nM | 150 nM | 15 nM | 40 nM |

Pairing ABT1-96 with ABT2-42

The $ND_{10}$ and $ND_{50}$ values determined from the MRC5 IL-1α and IL-1β neutralisation assay data are summarised in Table 44.

TABLE 44

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-96 | 3 nM | 11 nM | — | — |
| dAb ABT2-42 | — | — | 100 nM | 770 nM |
| Fab | ~3 nM | 30 nM | ~10 nM | 150 nM |

Pairing ABT1-141 with ABT2-65

The $ND_{10}$ and $ND_{50}$ values determined from the MRC5 IL-1α and IL-1β neutralisation assay data are summarised in Table 45.

TABLE 45

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-141 | 10 nM | 70 nM | — | — |
| dAb ABT2-65 | — | — | 100 nM | 266 nM |
| Fab | 80 nM | 300 nM | 300 nM | 1000 nM |

Pairing ABT1-122 with ABT2-65

The $ND_{10}$ and $ND_{50}$ values determined from the MRC5 IL-1α and IL-1β neutralisation assay data are summarised in Table 46.

TABLE 46

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-122 | 9 nM | 50 nM | — | — |
| dAb ABT2-65 | — | — | 100 nM | 266 nM |
| Fab | 40 nM | 800 nM | 1500 nM | 5000 nM |

Pairing ABT1-96 with ABT2-13

The $ND_{50}$ and $ND_{50}$ values determined from the MRC5 IL-1α and IL-1β neutralisation assay data are summarised in Table 47.

TABLE 47

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-96 | 3 nM | 11 nM | — | — |
| dAb ABT2-13 | — | — | 100 nM | 800 nM |
| Fab | 0.9 nM | 7 nM | 80 nM | N.D. |

Pairing ABT1-95 with ABT2-13

The $ND_{10}$ and $ND_{50}$ values determined from the MRC5 IL-1α and IL-1β neutralisation assay are summarised in Table 48.

TABLE 48

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-95 | 150 nM | 700 nM | — | — |
| dAb ABT2-13 | — | — | 100 nM | ~800 nM |
| Fab | 200 nM | 600 nM | 400 nM | N.D. |

Pairing ABT1-96 with ABT2-46
The $ND_{10}$ and $ND_{50}$ values determined from the MRC5 IL-1α and IL-1β neutralisation assay data are summarised in Table 49.

TABLE 49

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-96 | 3 nM | 11 nM | — | — |
| dAb ABT2-46 | — | — | 70 nM | 386 nM |
| Fab | 6 nM | 40 nM | 400 nM | N.D. |

Pairing ABT1-6-23 with ABT2-46
The $ND_{10}$ and $ND_{50}$ values determined from the MRC5 IL-1α and IL-1β neutralisation assay data are summarised in Table 50.

TABLE 50

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-6-23 | 3 nM | 30 nM | — | — |
| dAb ABT2-46 | — | — | 70 nM | 386 nM |
| Fab | 4 nM | 100 nM | 150 nM | 5000 nM |

Pairing ABT1-98 with ABT2-76
The $ND_{10}$ and $ND_{50}$ values determined from the MRC5 IL-1α and IL-1β neutralisation assay data are summarised in Table 51.

TABLE 51

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-98 | <100 nM | <100 nM | — | — |
| dAb ABT2-76 | — | — | 50 nM | 456 nM |
| Fab | 100 nM | 300 nM | 1500 nM | N.D. |

Pairing ABT1-6-23 with ABT2-13
The $ND_{10}$ and $ND_{50}$ values determined from the MRC5 IL-1α and IL-1β neutralisation assay data are summarised in Table 52.

TABLE 52

$ND_{50}$ and estimated $ND_{10}$ values for the dAb and Fab molecules.

| Clone Name | $ND_{10}$ IL-1α | $ND_{50}$ IL-1α | $ND_{10}$ IL-1β | $ND_{50}$ IL-1β |
|---|---|---|---|---|
| dAb ABT1-6-23 | 3 nM | 30 nM | — | — |
| dAb ABT2-13 | — | — | 100 nM | 800 nM |
| Fab | 40 nM | 200 nM | >500 nM | >500 nM |

In conclusion, these results demonstrate that it is possible to use a scFv-Fc fusion construct to express two $V_H$ dAbs to two different antigens in one recombinant protein and maintain dual-specificity and high potency.

Example 6

Dual specific IL-1α/IL-1β IgGs

As described above, phage display and emulsion technologies and yeast display, together with rational mutagenesis, produced a range of improved dAbs to IL-1α and IL-1β (some of which appeared to exceed the potency of the cell based assay, indicating that they have monomeric potencies in the very low picomolar or high femtomolar range). These dAbs were then used these to create a panel of dual targeting IgGs.

Examples 6.1-6.2 provide experiments that show that using dAbs identified and affinity matured, IgGs could be constructed that have sub-200 pM potencies to BOTH IL-1α and IL-1β, thus demonstrating that a fully human IgG can be generated that neutralises two separate targets as well as the best murine antibodies that are only able to neutralise one or the other target. Furthermore, in vitro these molecules inhibited IL-1 signalling better than the natural antagonist (IL-1ra) and yet did not bind to it, suggesting that in vivo the dual targeting IL-1 IgG should act in concert with IL-1ra.

The goal of the experiments in Example 6 was to provide a panel of IgGs that met the following criteria:
Two high-affinity Fab or Fab-like molecules, each with the following properties:
$K_d$ for IL-1α: $5 \times 10^{-10}$M or lower
$K_d$ for IL-1β: $5 \times 10^{-10}$M or lower $k_{off}$ for IL-1α: $10^{-4}$ $s^{-1}$ or lower
$k_{off}$ for IL-1β: $10^{-4}$ $s^{-1}$ or lower
Two IgG molecules corresponding to re-cloned versions of the two Fab or Fab-like molecules described above, each with the following properties:
$IC_{50}$ in RB assay for IL-1α: $9 \times 10^{-10}$M or lower
$IC_{50}$ in RB assay for IL-1β: $9 \times 10^{-10}$M or lower
$ND_{50}$ in MRC5 assay for IL-1α: $2 \times 10^{-10}$M or lower
$ND_{50}$ in MRC5 assay for IL-1β: $2 \times 10^{-10}$M or lower IgGs or Fabs containing the lead clones have also been tested in the Receptor Binding Assay (RBA) and the kinetics of their interaction with IL-1α and IL-1β were analysed using BIAcore.

The below experiments shows that multiple clones from the ABT1-95, ABT2-65 and ABT2-108 lineages formatted into IgGs meet the above criteria in the MRC5 and Receptor Binding Assays.

Example 6.1

MRC5 and Receptor Ligand Binding (RBA) Assay Data for IgG Pairings

Five clones ABT1-95, ABT1-122, ABT1-141, ABT2-65 and ABT2-108 were were paired as IgGs, and their inhibitory activity was tested in the MRC5 assay.
Table 53 contains a summary of the IgG pairings that were analysed in the MRC5 assay as the affinity maturation of each dAb progressed. This culminated in the identification of dual specific pairings that met the above criteria ($ND_{50}$ of <200 pM)—these are highlighted in bold in Table 53.

TABLE 53

Summary of the neutralisation of the dAb pairings as determined in the MRC5 bioassay over the course of the maturation program.

| ABT1 clone | ABT2 clone | MRC5 IL-1α (nM) | MRC5 IL-1β (nM) |
|---|---|---|---|
| 1-95-A3 | 2-108-538X | 0.032 | 0.023 |
| 1-95-A3 | 2-65-166 | 0.017 | 0.15 |
| 1-95-A2 | 2-65-166 | 0.08 | 0.121 |
| 1-95-A5 | 2-65-166 | 0.014 | 0.197 |
| 1-95-A6 | 2-65-166 | 0.019 | 0.207 |
| 1-95-15 | 2-65-17 | 2.7 | 0.094 |
| 1-95-15 | 2-108-538X | 8 | 0.042 |

TABLE 53-continued

Figure 22:
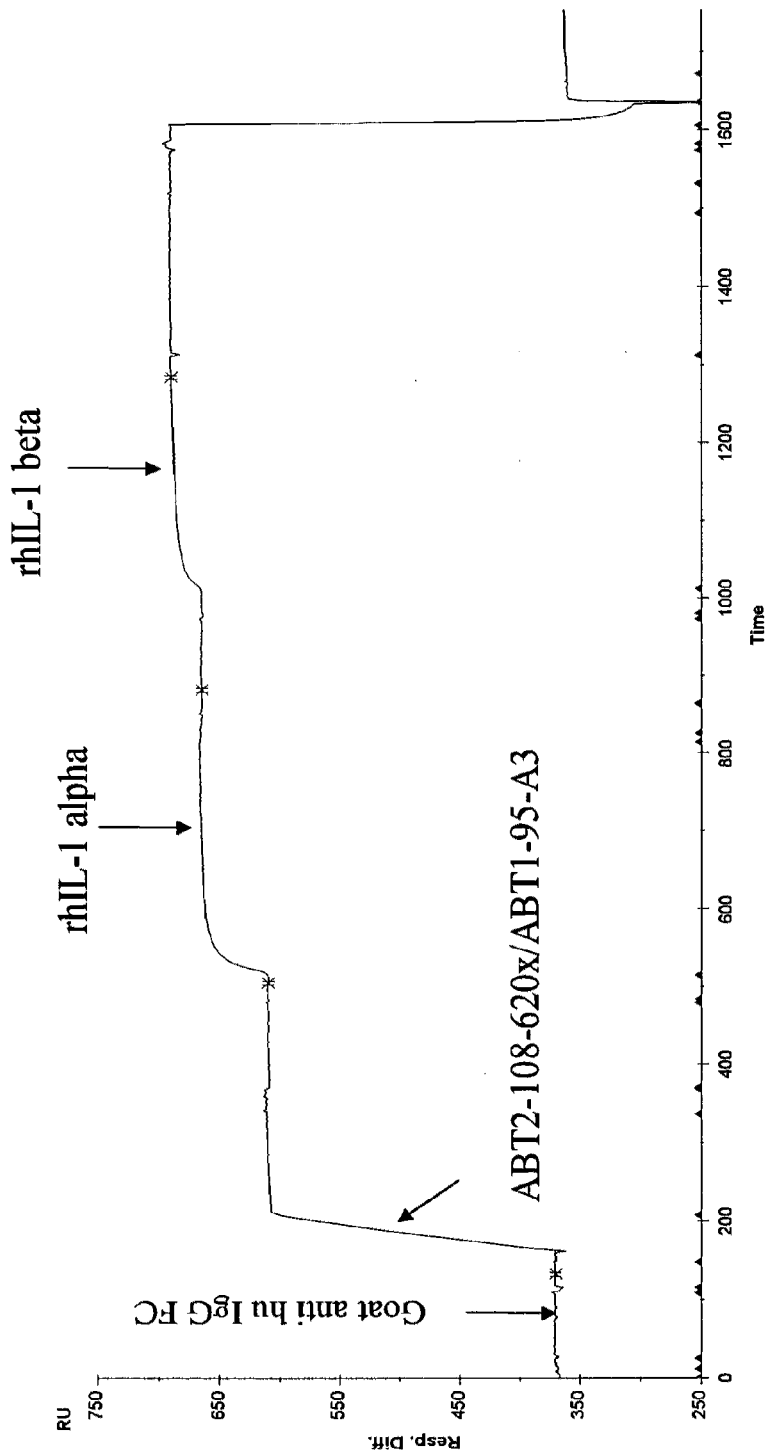
FIG. 22 shows simultaneous binding of rhIL-1 alpha followed by rhIL-1 beta to ABT 108-620x/ABT1-95-A3—showing non interfering independent binding

Summary of the neutralisation of the dAb pairings as determined in the MRC5 bioassay over the course of the maturation program alpha) and 200 nM for recombinant human IL-1 beta (rhIL-1 beta) was determined. rhIL-1 alpha (100 nM) was injected followed by rhIL-1 beta(200 nM). The analysis of this injection showed that the stoichiometry for rhIL-1 alpha was 2 and for rhIL-1 beta was 0.9 (see FIG. 22). In the next cycle, rhIL-1 beta (200 nM) was injected first followed by rhIL-1 alpha, and, in this case, the stoichiometry for the antigens remained the same as before.

The analysis showed that the antibody has a higher affinity for rhIL-1 alpha than rhIL-1 beta. The difference in affinity is in the off rate. In addition, the stoichiometry was different for these two analyte. Simultaneous binding of rhIL-1 alpha followed by rhIL-1 beta to the dual specific antibody showed non interfering independent binding (see FIG. 22). The reverse was also found, i.e., simultaneous binding of rhIL-1 beta followed by rhIL-1 alpha to ABT2-108-620x/ABT1-95-A3 showed non interfering independent binding (stoichiometry rhIL-1 alpha 2.0 and stoichiometry rhIL-1 beta 0.98).

Kinetic Analysis

Following the above, the kinetic analysis was preformed individually for rhIL-1 alpha and rhIL-1 beta. In case on rhIL-1 alpha the concentrations used were between 100-0.78 nM and for rhIL-1 beta the concentration range used was between 200-1.56 nM. Various concentrations of rhIL-1 alpha or rhIL-1 beta were injected over the captured antibody (1-5 ug/ml) using goat anti hu IgG FC capture. The surface was regenerated using 10 mM Glycine pH 1.5.

Results from the kinetic assay (bound IL-1 alpha or IL-1 beta to captured antibody) are provided in Table 59.

TABLE 59

Summary of Kinetic rate parameters by Biacore analysis:
Captured antibody: ABT2-108-620x/ABT1-95-A3

|  | rhIL-1 alpha | rhIL-1 beta |
|---|---|---|
| On Rate - ka (1/Ms) | Expt 1: $4.79 \times 10^5$<br>Expt 2: $4.92 \times 10^5$<br>Average: $4.855 \times 10^5$ | Expt 1: $3.15 \times 10^5$<br>Expt 2: $2.83 \times 10^5$<br>Average: $2.99 \times 10^5$ |
| Off Rate - kd | Expt 1: $4.25 \times 10^{-5}$ | Expt 1: $1.38 \times 10^{-4}$ |

TABLE 59-continued

Summary of Kinetic rate parameters by Biacore analysis:
Captured antibody: ABT2-108-620x/ABT1-95-A3

|  | rhIL-1 alpha | rhIL-1 beta |
|---|---|---|
| (1/s) | Expt 2: $4.11 \times 10^{-5}$<br>Average: $4.18 \times 10^{-5}$ | Expt 2: $1.02 \times 10^{-4}$<br>Average: $1.2 \times 10^{-4}$ |
| KD (pM) | Expt 1: 88.7<br>Expt 2: 83.5<br>Average: 86.1 | Expt 1: 446<br>Expt 2: 361<br>Average: 403.5 |

Thus, the binding to a first antigen does not interfere with the binding to a second antigen.

Example 9

In Vivo Inhibition of IL-1α or IL-1β Using Dual Specific IgG

The following example provides an in vivo experiment using the dual specific antibody, ABT2-108-620x/ABT1-95-A3, to inhibit IL-1α or IL-1β.

At days 7, 4, or 1 prior to cytokine challenge, C57B1/6N mice at 8 weeks of age were dosed with 200 μl of ABT2-108-620x/ABT1-95-A3 via intra-peritoneal injection (200 μg for IL-1α challenged animals and 50 μg for IL-1β challenged animals).

Animals were then challenged with 40 ng of rhIL-1α cytokine (Roche) or 60 ng of rhIL-1β cytokine (R&D Systems) in 100 μl by subcutaneous injection in the scruff of the neck. At 2 hours post cytokine challenge, animals were euthanized and terminally bled via cardiac puncture for plasma.

Figure 23:
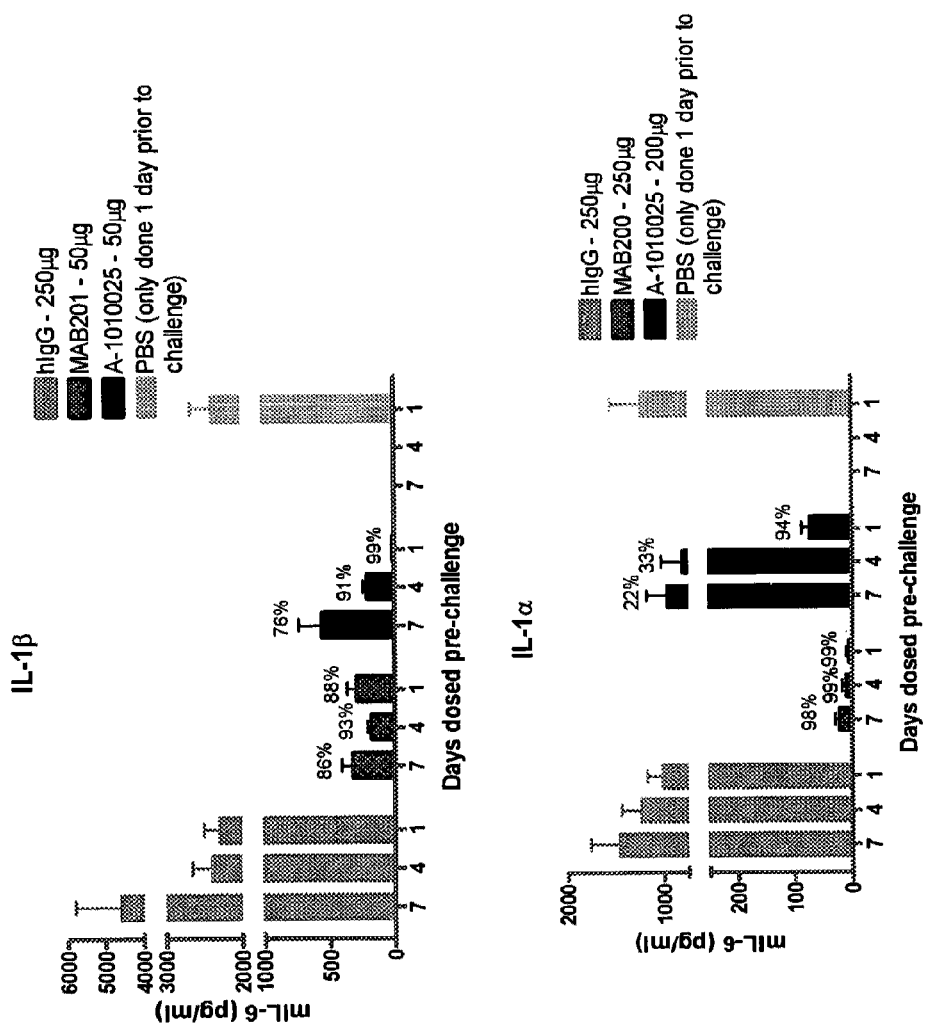
FIG. 23 shows IL-6 inhibition using an in vivo study to determine the efficacy of a dual specific antibody for inhabiting IL-1α and IL-1β activity. Key for figure reads top of key to left of figure, e.g., hIgG (250 μg) coincides to days 7, 4, and 1 beginning at left of x axis.

As shown in FIG. 23, treatment of animals with 50 μg of the anti-IL-1α/β, antibody ABT2-108-620x/ABT1-95-A3 significantly inhibited IL-6 production in response to rhIL-1β up to 7 days prior to challenge. IL-6 production in response to rhIL-1α was significantly inhibited by treatment with 200 μg of antibody 1 day prior to challenge, but not 4 or 7 days prior to challenge.

The following Tables (Tables 60 to 64) relate to the above examples.

TABLE 60

Domain Antibody Sequences

| Seq ID | VH | Sequences |
|---|---|---|
| 53 | VH Dummy | evqllesggglvqpggslrlscaasgftfssyamswvrqapgkglewv<br>gaisgsggstyyadsvkgrftisrdnskntlylqmnslraedtavyyc<br>aksygafdywgqgtlvtvss |
|  | VH to IL-1alpha |  |
| 54 | ABT1-207 | evqllesgggliqpggslrlscaasgftfgryymswvrqapgkglewv<br>ssidylgtntyyadsvkgrftisrdnskntlylqmnslraedtavyyc<br>akltrirppnfdywgqgtlvtvss |
| 55 | ABT1-6 | evqllesggglvqpggslrlscaasgftfgaydmqwvrqapgkglewv<br>ssinksgaltsyadsvkgrftisrdnskntlylqmnslraedtavyyc<br>akgwasfdywgqgtlvtvss |
| 56 | ABT1-6-15 | evqllesggglvqpggslrlscaasgftfvrydmawvrqapgkglewv<br>ssinksgaltsyadsvkgrftisrdnskntlylqmnslraedtavyyc<br>akgwasfdywgqgtlvtvss |
| 4 | ABT1-6-23 | evqllesggglvqpggslrlscaasgftfvrydmawvrqapgkglewv<br>ssiyksgaltsyadsvkgrftisrdnskntlylqmnslraedtavyyc<br>akgwasfdywgqgtlvtvss |
| 57 | ABT1-6-3 | evqllesggglvqpggslrlscaasgftfgaydmqwvrqapgkglewv<br>ssiyksgaltsyadsvkgrftisrdnskntlylqmnslraedtavyyc<br>akgwasfdywgqgtlvtvss |

TABLE 60-continued

Domain Antibody Sequences

| | | |
|---|---|---|
| 8 | ABT1-86 | evqllesggglvqpggslrlscaasgftfdryimawvrqapgkglewv ssitpsgaatyyadsvkgrftisrdnskntlylqmnslraedtavyyc aeepadrystwtfdywgqgtlvtvss |
| 16 | ABT1-96 | evqllesggglvqpggslrlscaasgftfnqynmfwvrqapgkglewv svisgsgrftyyadsvkgrftisrdnskntlylqmnslraedtavyyc akgwwrrdppfdywgqgtlvtvss |
| 20 | ABT1-98 | evqllesggglvqpggslrlscaasgftfdgyimswvrqapgkglewv stisplgsvtyyadsvkgrftisrdnskntlylqmnslraedtavyyc akkgpwfdywgqgtlvtvss |
| | VH to IL-1beta | |
| 58 | ABT2-10 | evqllesggglvqpggslrlsctasgftfnrynmawarqapgkglewv seidlkgsqtyyadsvkgrftisrdnskntlylqmnslraedtavyyc akvsisayhmfdywgqgtlvtvss |
| 52 | ABT2-108 | evqllesggglvqpggslrlscaasgftfaeytmmwvrqapgkglewv srigqdgkntyyadsvkgrftisrdnskntlylqmnslraedtavyyc akytgrvgvhhlfdywgqgtlvtvss |
| 59 | ABT2-108-504 | evqllesggglvqpggslrlscaasgftfadegmmwvrqapgkglewv srigqdgkntyyadsvkgrftisrdnskntlylqmnslraedtavyyc akytgrvgvhhlfdywgqgtlvtvss |
| 60 | ABT2-108-509 | evqllesggglvqpggslrlscaasgftfaeytmmwvrqapgkglewv sritysgkntyyadsvkgrftisrdnskntlylqmnslraedtavyyc akytgrvgvhhlfdywgqgtlvtvss |
| 61 | ABT2-108-511 | evqllesggglvqpggslrlscaasgftfaeytmmwvrqapgkglewv srigqdgkntvirdsvkgrftisrdnskntlylqmnslraedtavyyc akytgrvgvhhlfdywgqgtlvtvss |
| 62 | ABT2-108-512 (=611) | evqllesggglvqpggslrlscaasgftfaeytmmwvrqapgkglewv srigqdgkntyvlrsvkgrftisrdnskntlylqmnslraedtavyyc akytgrvgvhhlfdywgqgtlvtvss |
| 63 | ABT2-108-518 | evqllesggglvqpggslrlscaasgftfaeytmmwvrqapgkglewv srigqdgkntyyrmdvkgrftisrdnskntlylqmnslraedtavyyc akytgrvgvhhlfdywgqgtlvtvss |
| 64 | ABT2-108-521 | evqllesggglvqpggslrlscaasgftfaeytmmwvrqapgkglewv srigqdgkntyyadsvkgrftisrdnskntlylqmnslraedtavyyc akytgrilghhlfdywgqgtlvtvss |
| 65 | ABT2-108-524 | evqllesggglvqpggslrlscaasgftfaeytmmwvrqapgkglewv srigqdgkntyyadsvkgrftisrdnskntlylqmnslraedtavyyc akytgrvfnhhlfdywgqgtlvtvss |
| 66 | ABT2-108-527 | evqllesggglvqpggslrlscaasgftfaeytmmwvrqapgkglewv srigqdgkntyyadsvkgrftisrdnskntlylqmnslraedtavyyc akytgrvfkhhlfdywgqgtlvtvss |
| 67 | ABT2-108-533x | evqllesggglvqpggslrlscaasgftfadegmmwvrqapgkglewv srigqdgkntyyadsvkgrftisrdnskntlylqmnslraedtavyyc akytgrilghhlfdywgqgtlvtvss |
| 68 | ABT2-108-534x | evqllesggglvqpggslrlscaasgftfadegmmwvrqapgkglewv sritysgkntyyadsvkgrftisrdnskntlylqmnslraedtavyyc akytgrifshhlfdywgqgtlvtvss |
| 69 | ABT2-108-537x | evqllesggglvqpggslrlscaasgftfadegmmwvrqapgkglewv srigqdgkntyyrmdvkgrftisrdnskntlylqmnslraedtavyyc akytgrilghhlfdywgqgtlvtvss |
| 70 | ABT2-108-538x | evqllesggglvqpggslrlscaasgftfadegmmwvrqapgkglewv sritysgkntyyadsvkgrftisrdnskntlylqmnslraedtavyyc akytgrilghhlfdywgqgtlvtvss |
| 71 | ABT2-108-601 | evqllesggglvqpggslrlscaasgftfaeeswmwvrqapgkglewv srigqdgkntyyadsvkgrftisrdnskntlylqmnslraedtavyyc akytgrvgvhhlfdywgqgtlvtvss |
| 72 | ABT2-108-602 | evqllesggglvqpggslrlscaasgftfaeekymwvrqapgkglewv srigqdgkntyyadsvkgrftisrdnskntlylqmnslraedtavyyc akytgrvgvhhlfdywgqgtlvtvss |

TABLE 60-continued

Domain Antibody Sequences

| 73 | ABT2-108-603 | evqllesggglvqpggslrlscaasgftfaeytmmwvrqapgkglewv sritdagkntyyadsvkgrftisrdnskntlylqmnslraedtavyyc akytgrvgvhhlfdywgqgtlvtvss |
|---|---|---|
| 74 | ABT2-108-604 | evqllesggglvqpggslrlscaasgftfaeytmmwvrqapgkglewv srvtydgkntyyadsvkgrftisrdnskntlylqmnslraedtavyyc akytgrvgvhhlfdywgqgtlvtvss |
| 75 | ABT2-108-605 | evqllesggglvqpggslrlscaasgftfaeytmmwvrqapgkglewv srigqdgkntyyredvkgrftisrdnskntlylqmnslraedtavyyc akytgrvgvhhlfdywgqgtlvtvss |
| 76 | ABT2-108-606 | evqllesggglvqpggslrlscaasgftfaeytmmwvrqapgkglewv srigqdgkntyyrssvkgrftisrdnskntlylqmnslraedtavyyc akytgrvgvhhlfdywgqgtlvtvss |
| 77 | ABT2-108-607 | evqllesggglvqpggslrlscaasgftfaeytmmwvrqapgkglewv srigqdgkntyyrsdvkgrftisrdnskntlylqmnslraedtavyyc akytgrvgvhhlfdywgqgtlvtvss |
| 78 | ABT2-108-612 | evqllesggglvqpggslrlscaasgftfaeytmmwvrqapgkglewv srigqdgkntyyadsvkgrftisrdnskntlylqmnslraedtavyyc akytgrimghhlfdywgqgtlvtvss |
| 79 | ABT2-108-613 | evqllesggglvqpggslrlscaasgftfaeytmmwvrqapgkglewv srigqdgkntyyadsvkgrftisrdnskntlylqmnslraedtavyyc akytgrvfehhlfdywgqgtlvtvss |
| 80 | ABT2-108-617 | evqllesggglvqpggslrlscaasgftfaeytmmwvrqapgkglewv srigqdgkntyyadsvkgrftisrdnskntlylqmnslraedtavyyc akytgrifthhlfdywgqgtlvtvss |
| 81 | ABT2-108-620S | evqllesggglvqpggslrlscaasgftfseeswmwvrqapgkglewv srigqdgkntyyredvkgrftisrdnskntlylqmnslraedtavyyc akytgrimghhlfdywgqgtlvtvss |
| 82 | ABT2-108-620x | evqllesggglvqpggslrlscaasgftfaeeswmwvrqapgkglewv srigqdgkntyyredvkgrftisrdnskntlylqmnslraedtavyyc akytgrimghhlfdywgqgtlvtvss |
| 32 | ABT2-13 | evqllesggglvqpggslrlscaasgftfrdyvmywarqapgkglewv sridpmgsstyyadsvkgrftisrdnskntlylqmnslraedtavyyc akpegnfdywgqgtlvtvss |
| 44 | ABT2-65 | evqllesggglvqpggslrlscaasgftfedyqmgwvrqapgkglewv ssisamgnrtyyadsvkgrftisrddskntlylqmnslraedtavyyc aknlvrtqskmwmfdywgqgtlvtvss |
| 83 | ABT2-65-166 | evqllesggglvqpggslrlscaasgftfedyqmgwvrqapgkglewv ssisamggrtyyadsvkgrftisrdnskntlylqmnslraedtavyyc aqnlvrlgrsrwmfdywgqgtlvtvss |
| 84 | ABT2-65-166S | evqllesggglvqpggslrlscaasgftfsdyqmgwvrqapgkglewv ssisamggrtyyadsvkgrftisrdnskntlylqmnslraedtavyyc aqnlvrlgrsrwmfdywgqgtlvtvss |
| 85 | ABT2-65-166SK | evqllesggglvqpggslrlscaasgftfsdyqmgwvrqapgkglewv ssisamggrtyyadsvkgrftisrdnskntlylqmnslraedtavyyc aknlvrlgrsrwmfdywgqgtlvtvss |
| 86 | ABT2-65-17 | evqllesggglvqpggslrlscvasgftfedyqmgwvrqapgkglewv ssisamgnrtyyadsvkgrftisrddskntlylqmnslraedtavyyc aqnlvrlgrsrwmfdywgqgtlvtvss |
| 87 | ABT2-65-201 | evqllesggglvqpggslrlscvasgftfedyqmgwvrqapgkglewv ssisamgrrtyyadsvkgrftisrdnskntlylqmnslraedtavyyc aqnlvrlgrsrwmfdywgqgtlvtvss |
| 88 | ABT2-65-203 | evqllesggglvqpggslrlscvasgftfedyqmgwvrqapgkglewv ssisamgfrtyyadsvkgrftisrdnskntlylqmnslraedtavyyc aqnlvrlgrsrwmfdywgqgtlvtvss |
| 89 | ABT2-65-8 | evqllesggglvqpggslrlscaasgftfedyqmgwvrqapgkglewv ssisamgnrtyyadsvkgrftisrddskntlylqmnslraedtavyyc aqnlvrmdsrrwmfdywgqgtlvtvss |

TABLE 60-continued

Domain Antibody Sequences

| | | |
|---|---|---|
| 90 | ABT2-65-B1 | evqllesggglvqpggslrlscvasgftfedyqmgwvrqapgkglewv ssisamggrtyyadsvkgrftisrddskntlylqmnslraedtavyyc aqnlvrlgrsrwmfdywgqgtlvtvss |
| 91 | ABT2-65-B2 | evqllesggglvqpggslrlscvasgftfedyqmgwvrqapgkglewv ssisamgrrtyyadsvkgrftisrddskntlylqmnslraedtavyyc aqnlvrlgrsrwmfdywgqgtlvtvss |
| 92 | ABT2-65-B3 | evqllesggglvqpggslrlscvasgftfedyqmgwvrqapgkglewv ssisamgnrayyadsvkgrftisrddskntlylqmnslraedtavyyc aqnlvrlgrsrwmfdywgqgtlvtvss |

| Seq ID | VL | Sequences |
|---|---|---|
| 93 | Vk Dummy | diqmtqspsslsasvgdrvtitcrasqsissylnwyqqkpgkapkll iyaasslqsgvpsrfsgsgsgtdftltisslqpedfatyycqqsyst pntfgqgtkveikr |

VL to IL-1alpha

| | | |
|---|---|---|
| 24 | ABT1-122 | diqmtqspsslsasvgdrvtitcrasqpiwtelnwyqqkpgkapkll iygssslqsgvpsrfsgsgsgtdftltisslqpedfatyycqqfayf patfgqgtkveikr |
| 94 | ABT1-122-505 | diqmtqspsslsasvgdrvtitcrasqpiwtelnwyqqkpgkapkll iygssslqsgvpsrfsgsgsgtdftltisslqpedfatyyckqfayf patfgqgtkveikr |
| 95 | ABT1-122-508 | diqmtqspsslsasvgdrvtitcrasqpiwtelnwyqqkpgkapkll iygssslqrgvpsrfsgsgsgtdftltisslqpedfatyycqqfayf patfgqgtkveikr |
| 96 | ABT1-122-510 | diqmtqspsslsasvgdrvtitcrfsypiwtelnwyqqkpgkapkll iygssslqsgvpsrfsgsgsgtdftltisslqpedfatyycqqfayf patfgqgtkveikr |
| 97 | ABT1-122-511 | diqmtqspsslsasvgdrvtitcrasqpiwtelnwyqqkpgkapkll iygssslqrgvpsrfsgsgsgtdftltisslqpedfatyyckqfayf patfgqgtkveikr |
| 98 | ABT1-122-512 | diqmtqspsslsasvgdrvtitcrasqpiwtelnwyqqkpgkapkll iygsakrqrgvpsrfsgsgsgtdftltisslqpedfatyyckqfayf patfgqgtkveikr |
| 99 | ABT1-122-513 | diqmtqspsslsasvgdrvtitcrasqpiwtelnwyqqkpgkapkll iygsgsrqrgvpsrfsgsgsgtdftltisslqpedfatyyckqfayf patfgqgtkveikr |
| 100 | ABT1-122-551 | diqmtqspsslsasvgdrvtitcrakfniwtelnwyqqkpgktpkll iygssslqsgvpsrfsgsgsgtdftltisslqpedfatyycqqfayf patfgqgtkveikr |
| 101 | ABT1-122-552 | diqmtqspsslsasvgdrvtitcraslgvwtelnwyqqkpgkapkll iygssslqsgvpsrfsgsgsgtdftltisslqpedfatyycqqfayf patfgqgtkveikr |
| 102 | ABT1-122-553 | diqmtqspsslsasvgdrvtitcrasqpiwtelkwyqqkpgkapkll iygssslqsgvpsrfsgsgsgtdftltisslqpedfatyycqqfayf patfgqgtkveikr |
| 103 | ABT1-122-554 | diqmtqspsslsasvgdrvtitcrasqpiwtelnwyqqkpgkapkll iygssslqsgvpsrfsgsgsgtdftltisslqpedfatyycqqfayf patfgqetkveikr |
| 104 | ABT1-122-555 | diqmtqspsslsasvgdrvtitcrasqpiwtelnwyqqkpgktpkll iygssslqsgvpsrfsgsgsgtdftltisslqpedfatyycqqfayf patfgqgtkveikr |
| 105 | ABT1-122-556 | diqmtqspsslsasvgdrvtitcrasqpiwtelnwyqqkpgkapkll iygssslqsgvpsrfsgsgsgtdftltisslqpedfatyhcqqfayf patfgqgtkveikr |
| 106 | ABT1-122-557 | diqmtqspsslsasvgdrvtitcrasqpiwtelnwyqqkpgkapkll iygssslqsgvpsrfsgsgsgtdftltisslqpedfatyycqqfayf patlgqgtkveikr |

TABLE 60-continued

Domain Antibody Sequences

| | | |
|---|---|---|
| 107 | ABT1-122-750M | diqmtqspsslsasvgdrvtitcsasqhiwtemswyqqkpgkapkll<br>iygsasrqkgvpsrfsgsgsgtdftltisslqpedfatyyckqfayf<br>pntfgqgtkveikr |
| 108 | ABT1-122-750MH | diqmtqspsslsasvgdrvtitcsasqhiwtemswyqqkpgkapkll<br>iygsasrqkgvpsrfsgsgsgtdftltisslqpedfatyhckqfayf<br>pntfgqgtkveikr |
| 109 | ABT1-122-750MT | diqmtqspsslsasvgdrvtitcsasqhiwtemswyqqkpgktpkll<br>iygsasrqkgvpsrfsgsgsgtdftltisslqpedfatyyckqfayf<br>pntfgqgtkveikr |
| 110 | ABT1-122-750T | diqmtqspsslsasvgdrvtitcsasqhiwteiswyqqkpgkapkll<br>iygsasrqkgvpsrfsgsgsgtdftltisslqpedfatyyckqfayf<br>pntfgqgtkveikr |
| 111 | ABT1-122-750x | diqmtqspsslsasvgdrvaitcsasqhiwteiswyqqkpgkapkll<br>iygsasrqkgvpsrfsgsgsgtdftltisslqpedfatyyckqfayf<br>pntfgqgtkveikr |
| 112 | ABT1-122-750xH | diqmtqspsslsasvgdrvaitcsasqhiwteiswyqqkpgkapkll<br>iygsasrqkgvpsrfsgsgsgtdftltisslqpedfatyhckqfayf<br>pntfgqgtkveikr |
| 28 | ABT1-141 | diqmtqspsslsasvgdrvtitcrasqwiqkqlawyqqkpgkapkll<br>iysssylqsgvpsrfsgsgsgtdftltisslqpedfatyycqqhlrv<br>pftfgqgtkveikr |
| 113 | ABT1-141-25 | diqmtqspsslsasvgdrvtitcrasqwiqkqlawyqqkpgkapkll<br>iysssylqsgvpsrfsgsgsgtdftltisslqpedfatyycqqhlrv<br>pmtfgqgtkveikr |
| 114 | ABT1-141-29 | diqvtqspsslsasvgdrvtitcrasqwiqkqlawyqlkpgkapkll<br>iysssylqsgvpsrfsgsgsgtdftltisslqpedfatyycqqhlrv<br>pftfgqgtkveikr |
| 115 | ABT1-18 | diqmtqspsslsasvgdrvtitcrasqsiqrwlawyqqkpgkapkll<br>iyfasqlqsgvpsrfsqsgsgtdftltisslqpedfatyycqqllrl<br>pktfgqgtkveikr |
| 116 | ABT1-212 | diqmtqspsslsasvgdrvtitcrasqringnlrwyqqkpgkapkll<br>iysvsqlqsgvpsrfsgsgsgtdftltisslqpedfatyycqqgydw<br>pptfgqgtkvetkr |
| 117 | ABT1-221 | diqmtqspsslsasvgdrvtitcrasqdiwpylmwyqqkpgkapkll<br>iyyssmlqsgvpsrfsgsgsgtdftltisslqpedfatyycqqfrrw<br>pytfgqgtkveikr |
| 118 | ABT1-222 | diqmtqspsslsasvgdrvtitcrasqpitrnlrwyqqkpgkapkll<br>iyhssvlqsgvpsrfsgsgsgtdftltisslqpedfatyycqqgyrw<br>pvtfgqgtkveikr |
| 119 | ABT1-3 | diqmtqspsslsasvgdrvtitcrasqsiwtelkwyqqkpgkapkll<br>iygasllqsgvpsrfsgsgsgtdftltisslqpedfatyycqqfayf<br>pftfgqgtkveikr |
| 120 | ABT1-9 | diqmtqspsslsasvgdrvtitcrasqsigssllwyqqkpgkapkll<br>iylasrlqsgvpsrfsgsgsgtdftltisslqpedfatyycqqfrst<br>pntfgqgtkveikr |
| 12 | ABT1-95 | diqmtqspsslsasvgdrvtitcrasqpihgnlrwyqqkpgkapkll<br>iynisnlqsgvpsrfsgsgsgtdftltisslqpedfatyycqqgyrw<br>pvtfgqgtkveikr |
| 121 | ABT1-95-15 | diqmtqspsslsasvgdrvtitcrasqpivrnlrwyqqkpgkapkll<br>iysssylepgvpsrfsgsgsgtdftltisslqpedfatyhcqqgyrw<br>pvtfgqgtkveikr |
| 122 | ABT-95-174 | diqmtqspsslsasvgdrvtitcrasrpivrnlrwyqqkpgkapkll<br>iysvsylepgvpsrfsgsgsgtdftltisslqpedfatyhcrqgyrw<br>pvtfgqgtkveikr |
| 123 | ABT1-95-177 | diqmtqspsslsasvgdrvtitcrasqpivrnlrwyqqkpgkapkll<br>iyassylepgvpsrfsgsgsgtdftltisslqpedfatyhcrqgyrw<br>pvtfgqgtkveikr |

TABLE 60-continued

Domain Antibody Sequences

| | | |
|---|---|---|
| 124 | ABT1-95-181 | diqmtqspsslsasvgdrvtitcraskpivrnmrwyqqkpgkapkll iysvsylepgvpsrfsgsgsgtdftltisslqpedfatyhclqgyrw pptfgqgtkveikr |
| 125 | ABT1-95-182 | diqmtqspsslsasvgdrvtitcraskpgvrnlrwyqqkpgkapkll iysvsylepgvpsrfsgsgsgtdftltisslqpedfatyhclqgyrw pptfgqgtkveikr |
| 126 | ABT1-95-184 | diqmtqspsslsasvgdrvtitcrasrtpvrnlrwyqqkpgkapkll iysrsylepgvpsrfsgsgsgtdftltisslqpedfatyhclqgyrw pptfgqgtkveikr |
| 127 | ABT1-95-3 | diqmtqspsslsasvgdrvtitcrasqpihgnlrwyqqkpgkapkll iysssylqsgvpsrfsgsgsgtdftltisslqpedfatyhcqqgyrw pvtfgqgtkveikr |
| 128 | ABT1-95-A1 | diqmtqspsslsasvgdrvtitcrasrpgvrnlrwyqqkpgkapkll iyhvsdlepgvpsrfsgsgsgtdftltisslqpedfatyhcrqgyvw pvpfdqgtkveikr |
| 129 | ABT1-95-A2 | diqmtqspsslsasvgdrvtitcrilqppgrnlrwyqqkpgkapkll iysksflepgvpsrfsgsgsgtdftltisslqpedfatyhcqqgyrw pvtfgqgtkveikr |
| 130 | ABT1-95-A3 | diqmtqspsslsasvgdrvtitcraskpgvrnmrwyqqkpgkapkll iysvsylepgvpsrfsgsgsgtdftltisslqpedfatyhclqgyrw pptfgqgtkveikr |
| 131 | ABT1-95-A4 | diqmtqspsslsasvgdrvtitcrasrpgvrnlrwyqqkpgkapkll iysrsflepgvpsrfsgsgsgtdftltisslqpedfatyhclqgyrw pptfgqgtkveikr |
| 132 | ABT1-95-A5 | diqmtqspsslsasvgdrvtitcrasrtpvrnlrwyqqkpgkapkll iysrsflepgvpsrfsgsgsgtdftltisslqpedfatyhclqgyrw pptfgqgtkveikr |
| 133 | ABT1-95-A6 | diqmtqspsslsasvgdrvtitcraskpgvrnmrwyqqkpgkapkll iyaksylepgvpsrfsgsgsgtdftltisslqpedfatyhckqgyrw pvqfgqgtkveikr |
| | VL to IL-1beta | |
| 36 | ABT2-42 | diqmtqspsslsasvgdrvtitcrasqyiekwltwyqqkpgkaptll iyrgsllqsgvpsrfsgsgsgtdftltisslqpedfatyycqqteyw pftfgqgtkveikr |
| 40 | ABT2-46 | diqmtqspsslsasvgdrvtitcrasqsiiewlswyqqkpgkapkll iyrtsvlqsgvpsrfsgsgsgtdftltisslqpedfatyycqqnefw pftfgqgtkveikr |
| 48 | ABT2-76 | diqmtqspsslsasvgdrvtitcrasqsidrwlawyqqkpgkapkll iyrgsilqsgvpsrfsgsgsgtdftltisslqpedfatyycqqvafw pptfgqgtkveikr |

TABLE 61

Summary of identified single domain antibodies

| Name (Clone-type) | CDR1 | CDR2 | CDR3 | MRC5 ND$_{50}$ | $K_D$ (M) | AMINO ACID SEQUENCE (diversified residues are indicated in bold; CDRs are underlined) |
|---|---|---|---|---|---|---|
| IL1α Clone | | | | | | |
| ABT1-6-23 (VH) | VRYDMA (SEQ ID NO: 1) | SIYKSGALTSYDS VKG (SEQ ID NO: 2) | GWASFDY (SEQ ID NO: 3) | 0.03 μM | 6.1 × 10$^{-8}$ | EVQLLESGGGLVQPGGSLRLSCAASGFTFVRYDMAWVRQAPGKGLEWVSSIYKSGALTSYDSKNTLYLQMNSLRAEDTAVYYCAKGWASFDYWGQGTLVTVSS (SEQ ID NO: 4) |
| ABT1-86 (VH) | RYIMA (SEQ ID NO: 5) | SITPSGAATYYAD SVKG (SEQ ID NO: 6) | EPADRYSTW TFDY (SEQ ID NO: 7) | 900 nM | 1.1 × 10$^{-7}$ | EVQLLESGGGLVQPGGSLRLSCAASGFTFDRYIMAWVRQAPGKGLEWVSSITPSGAATYYADSVKGRFTISRDNSKNTLYLQMNSLRAEDTAVYYCAEEPADRYSTWTFDYWGQGTLVTVSS (SEQ ID NO: 8) |
| ABT1-95 (VK) | RASQPIHGNLR (SEQ ID NO: 9) | NISNLQS (SEQ ID NO: 10) | QQGYRWPVT (SEQ ID NO: 11) | 800 nM | 4.5 × 10$^{-8}$ | DIQMTQSPSSLSASVGDRVTITCRASQPIHGNLRWYQQKPGKAPKLLIYNISNLQSGVPSRFSGSGSGTDFTLTISSLQPEDFATYYCQQGYRWPVTFGQGTKVEIKR (SEQ ID NO: 12) |
| ABT1-96 (VH) | QYNMF (SEQ ID NO: 13) | VISGSGRFTYADS VKG (SEQ ID NO: 14) | GWWRDPPF DY (SEQ ID NO: 15) | 11 nM | 1.1 × 10$^{-9}$ | EVQLLESGGGLVQPGGSLRLSCAASGFTFNQYNMFWVRQAPGKGLEWVSVISGSGRFTYADSVKGRFTISRDNSKNTLYLQMNSLRAEDTAVYYCAKGWWRDPPFDYWGQGTLVTVSS (SEQ ID NO: 16) |
| ABT1-98 (VH) | GYIMS (SEQ ID NO: 17) | TISPLGSVTYYAD SVKG (SEQ ID NO: 18) | KGPWFDY (SEQ ID NO: 19) | 30 nM | 1.3 × 10$^{-8}$ | EVQLLESGGGLVQPGGSLRLSCAASGFTFDGYIMSWVRQAPGKGLEWVSTISPLGSVTYYADSVKGRFTISRDNSKNTLYLQMNSLRAEDTAVYYCAKKGPWFDYWGQGTLVTVSS (SEQ ID NO: 20) |
| ABT1-122 (VK) | RASQPIWTELN (SEQ ID NO: 21) | GSSSLQS (SEQ ID NO: 22) | QQFAYPPAT (SEQ ID NO: 23) | 50 nM | 4.2 × 10$^{-8}$ | DIQMTQSPSSLSASVGDRVTITCRASQPIWTELNWYQQKPGKAPKLLIYGSSSLQSGVPRFSGSGSGTDFTLTISSLQPEDFATYYCQQFAYPPATFGQGTKVEIKR (SEQ ID NO: 24) |
| ABT1-141 (VK) | RASQWIQKQLA (SEQ ID NO: 25) | SSSYLQS (SEQ ID NO: 26) | QQHLRVPFT (SEQ ID NO: 27) | 50 nM | 3.0 × 10$^{-7}$ | DIQMTQSPSSLSASVGDRVTITCRASQWIQKQLAWYQQKPGKAPKLLIYSSSYLQSGVPRFSGSGSGTDFTLTISSLQPEDFATYYCQQHLRVPFTFGQGTKVEIKR (SEQ ID NO: 28) |
| IL1β Clone Name | | | | | | |
| ABT2-13 (VH) | DYVMY (SEQ ID NO: 29) | RIDPMGSSTYYAD SVKG (SEQ ID NO: 30) | PEGNFDY (SEQ ID NO: 31) | ~1000 nM | 9.3 × 10$^{-7}$ | EVQLLESGGGLVQPGGSLRLSCAASGFTFRDYVMYWARQAPGKGLEWVSRIDPMGSSTYYADSVKGRFTISRDNSKNTLYLQMNSLRAEDTAVYYCAKPEGNFDYWGQGTLVTVSS (SEQ ID NO: 32) |
| ABT2-42 (VK) | RASQYIEKWLT (SEQ ID NO: 33) | RGSLLQS (SEQ ID NO: 34) | QQTEYWPFT (SEQ ID NO: 35) | 770 nM | 5.4 × 10$^{-5}$ | DIQMTQSPSSLSASVGDRVTITCRASQYIEKWLTWYQQKPGKAPTLLIYRGSLLQSGVPRFSGSGSGTDFTLTISSLQPEDFATYYCQQTEYWPFTFGQGTKVEIKR (SEQ ID NO: 36) |
| ABT2-46 (VK) | RASQSIIEWLS (SEQ ID NO: 37) | RTSVLQS (SEQ ID NO: 38) | QQNEFWPFT (SEQ ID NO: 39) | 386 nM | 2.8 × 10$^{-6}$ | DIQMTQSPSSLSASVGDRVTITCRASQSIIEWLSWYQQKPGKAPKLLIYRTSVLQSGVPSRFSGSGSGTDFTLTISSLQPEDFATYYCQQNEFWPTF |

TABLE 61-continued

Summary of identified single domain antibodies

| | CDR1 | CDR2 | CDR3 | MRC5 ND$_{50}$ | K$_D$ (M) | AMINO ACID SEQUENCE (diversified residues are indicated in bold; CDRs are underlined) |
|---|---|---|---|---|---|---|
| ABT2-65 (VH) | DYQMG (SEQ ID NO: 41) | SISAMGNRTYYAD SVKG (SEQ ID NO: 42) | NLVRTQSKM WMFDY (SEQ ID NO: 43) | 266 nM | 2.8 × 10$^{-8}$ | GQGTKVEIKR (SEQ ID NO: 40) EVQLLESGGGLVQPGGSLRLSCAASGFTFEDYQMGWVRQAPGKGLEWVS SISAMGNRTYYADSVKGRFTISRDDSKNTLYLQMNSLRAEDTAVYYCAK NLVRTQSKMWMFDYWGQGTLVTVSS (SEQ ID NO: 44) |
| ABT2-76 (VK) | RASQSIDRWLA (SEQ ID NO: 45) | RGSILQS (SEQ ID NO: 46) | QQVAFWPPT (SEQ ID NO: 47) | 456 nM | 1.3 × 10$^{-6}$ | DIQMTQSPSSLSASVGDRVTITCRASQSIDRWLAWYQQKPGKAPKLLIY RGSILQSGVPSRFSGSGSGTDFTLTISSLQPEDFATYYCQQVAFWPPTF GQGTKVEIKR (SEQ ID NO: 48) |
| ABT2-108 (VH) | EYTMM (SEQ ID NO: 49) | RIGQDGKNTYYAD SVKG (SEQ ID NO: 50) | YTGRVGVHH LFDY (SEQ ID NO: 51) | 200 nM | 1.1 × 10$^{-7}$ | EVQLLESGGGLVQPGGSLRLSCAASGFTFAEYTMMWVRQAPGKGLEWVS RIGQDGKNTYYADSVKGRFTISRDNSKNTLYLQMNSLRAEDTAVYYCAK YTGRVGVHHLFDYWGQGTLVTSS (SEQ ID NO: 52) |

TABLE 62

| | | ABT 1 dAbs | | |
|---|---|---|---|---|
| Clone Name | dAb | IC$_{50}$ [nM] | ND$_{50}$ [nM] | K$_D$ [nM] |
| ABT1-3 | VK | | 1000 | |
| ABT1-6 | VH | 3000 | 3000 | |
| ABT1-6-3 | VH | 80 | 60 | |
| ABT1-6-15 | VH | 200 | 500 | |
| ABT1-6-23 | VH | 30 | 30 | 6 |
| ABT1-7 | VH | | | |
| ABT1-8 | VH | | | |
| ABT1-9 | VK | | 4000 | |
| ABT1-9-500 | VK | | | |
| ABT1-10 | VK | | >20000 | |
| ABT1-11 | VK | | >20000 | |
| ABT1-12 | VK | | | |
| ABT1-13 | VK | | | |
| ABT1-14 | VK | | | |
| ABT1-15 | VH | | | |
| ABT1-17 | VH | | | |
| ABT1-18 | VK | | >10000 | |
| ABT1-19 | VH | | | |
| ABT1-20 | VH | | 1000 | |
| ABT1-21 | VH | | | |
| ABT1-22 | VH | | 7000 | |
| ABT1-23 | VH | | 5000 | |
| ABT1-24 | VK | | | |
| ABT1-25 | VK | | | |
| ABT1-26 | VK | | | |
| ABT1-27 | VK | | | |
| ABT1-28 | VK | | | |
| ABT1-29 | VK | | | |
| ABT1-30 | VK | | | |
| ABT1-31 | VH | | | |
| ABT1-32 | VH | | | |
| ABT1-33 | VH | | | |
| ABT1-34 | VH | | | |
| ABT1-35 | VH | | | |
| ABT1-36 | VH | | | |
| ABT1-37 | VH | | | |
| ABT1-38 | VH | | | |
| ABT1-40 | VH | | | |
| ABT1-41 | VH | | | |
| ABT1-42 | VH | | | |
| ABT1-43 | VH | | | |
| ABT1-45 | VH | | | |
| ABT1-46 | VH | | | |
| ABT1-47 | VH | | 5000 | |
| ABT1-49 | VH | | | |
| ABT1-50 | VH | | | |
| ABT1-51 | VH | | | |
| ABT1-52 | VH | | | |
| ABT1-53 | VK | | | |
| ABT1-54 | VK | | | |
| ABT1-56 | VK | | | |
| ABT1-57 | VK | | | |
| ABT1-59 | VK | | | |
| ABT1-60 | VK | | | |
| ABT1-61 | VK | | | |
| ABT1-62 | VK | | | |
| ABT1-63 | VK | | | |
| ABT1-64 | VK | | | |
| ABT1-65 | VK | | | |
| ABT1-66 | VK | | | |
| ABT1-67 | VK | | 0.044 | |
| ABT1-68 | VK | | | |
| ABT1-75 | VH | | | |
| ABT1-76 | VH | | | |
| ABT1-77 | VH | | | |
| ABT1-78 | VH | | | |
| ABT1-79 | VH | | | |
| ABT1-81 | VH | | | |
| ABT1-82 | VK | | | |
| ABT1-84 | VH | >10000 | 3000 | |
| ABT1-85 | VH | >10000 | 30000 | |
| ABT1-86 | VH | 1000 | 900 | |
| ABT1-87 | VH | >10000 | >10000 | |
| ABT1-88 | VH | >10000 | >10000 | |
| ABT1-89 | VH | >10000 | >10000 | |
| ABT1-90 | VH | >10000 | >10000 | |
| ABT1-91 | VH | >10000 | >10000 | |
| ABT1-92 | VH | >10000 | >10000 | |
| ABT1-93 | VH | >10000 | 5000 | |
| ABT1-94 | VH | | | |
| ABT1-95 | VK | 500 | 800 | |
| ABT1-95-3 | VK | 4 | 80 | 7 |
| ABT1-95-4 | VK | 0.7 | 2 | 1.5 |
| ABT1-95-6 | VK | 0.8 | 1 | 2.1 |
| ABT1-95-8 | VK | 0.8 | 1 | 2.1 |
| ABT1-95-9 | VK | 0.8 | — | 1 |
| ABT1-95-10 | VK | 0.8 | — | 0.9 |
| ABT1-95-11 | VK | 0.9 | 0.300 | 1.1 |
| ABT1-95-12 | VK | 0.8 | — | 0.9 |
| ABT1-95-13 | VK | 0.3 | 0.120 | 0.9 |
| ABT1-95-14 | VK | 0.3 | 0.250 | 1.2 |
| ABT1-95-15 | VK | 0.3 | 0.045 | 0.4 |
| ABT1-95-21 | VK | 0.5 | 0.61 | |
| ABT1-95-22 | VK | 0.5 | 1 | |
| ABT1-95-23 | VK | 0.5 | 0.5 | |
| ABT1-95-24 | VK | 0.5 | 0.27 | |
| ABT1-95-25 | VK | 0.5 | 0.43 | |
| ABT1-95-26 | VK | 0.5 | 0.71 | |
| ABT1-95-27 | VK | 0.5 | 1 | |
| ABT1-95-28 | VK | >0.5 | 2 | |
| ABT1-95-29 | VK | >0.5 | 1 | |
| ABT1-95-30 | VK | >1 | >10 | |
| ABT1-95-31 | VK | >0.5 | 3.3 | |
| ABT1-95-32 | VK | >0.5 | 1.2 | |
| ABT1-95-33 | VK | 0.5 | 1 | |
| ABT1-95-34 | VK | 0.1 | 1 | |
| ABT1-95-35 | VK | 0.2 | | |
| ABT1-95-36 | VK | <0.1 | | |
| ABT1-95-37 | VK | 0.1 | | |
| ABT1-95-38 | VK | <0.1 | 0.119 | |
| ABT1-95-39 | VK | 0.2 | | |
| ABT1-95-40 | VK | | | |
| ABT1-95-41 | VK | <0.1 | 0.150 | |
| ABT1-95-42 | VK | 0.1 | | |
| ABT1-95-43 | VK | | | |
| ABT1-95-44 | VK | <0.1 | 0.150 | |
| ABT1-95-45 | VK | | | |
| ABT1-95-46 | VK | 0.8 | | |
| ABT1-95-47 | VK | 0.1 | 0.139 | |
| ABT1-95-48 | VK | | | |
| ABT1-95-49 | VK | | 274 | |
| ABT1-95-50 | VK | 0.5 | | |
| ABT1-95-51 | VK | | 615 | |
| ABT1-95-52 | VK | 1 | | |
| ABT1-95-53 | VK | 0.3 | | |
| ABT1-95-54 | VK | 1 | | |
| ABT1-95-55 | VK | 0.6 | | |
| ABT1-95-56 | VK | 0.3 | | |
| ABT1-95-57 | VK | 0.6 | | |
| ABT1-95-58 | VK | 0.6 | | |
| ABT1-95-59 | VK | 0.3 | | |
| ABT1-95-60 | VK | 0.7 | | |
| ABT1-95-61 | VK | 0.3 | | |
| ABT1-95-62 | VK | 0.1 | | |
| ABT1-95-63 | VK | 0.6 | | |
| ABT1-95-64 | VK | 3 | 0.438 | |
| ABT1-95-65 | VK | 0.2 | | |
| ABT1-95-67 | VK | 0.1 | 0.044 | |
| ABT1-95-68 | VK | 0.2 | | |
| ABT1-95-69 | VK | 1 | | |
| ABT1-95-70 | VK | 0.1 | | |
| ABT1-95-71 | VK | 1 | | |
| ABT1-95-72 | VK | 1 | | |
| ABT1-95-73 | VK | 3 | | |
| ABT1-95-74 | VK | 0.3 | | |
| ABT1-95-75 | VK | 0.3 | | |
| ABT1-95-76 | VK | 0.3 | | |
| ABT1-95-77 | VK | 0.3 | | |
| ABT1-95-78 | VK | 0.3 | | |
| ABT1-95-79 | VK | 0.3 | | |

TABLE 62-continued

ABT 1 dAbs

| Clone Name | dAb | IC$_{50}$ [nM] | ND$_{50}$ [nM] | K$_D$ [nM] |
|---|---|---|---|---|
| ABT1-95-80 | VK | 0.3 | 0.008 | |
| ABT1-95-81 | VK | 0.3 | | |
| ABT1-95-82 | VK | 0.4 | | |
| ABT1-95-83 | VK | 0.2 | | |
| ABT1-95-84 | VK | | | |
| ABT1-95-85 | VK | 0.2 | 0.713 | |
| ABT1-95-86 | VK | 0.1 | 0.2 | |
| ABT1-95-87 | VK | 0.2 | | |
| ABT1-95-88 | VK | 0.2 | 0.714 | |
| ABT1-95-89 | VK | 0.3 | | |
| ABT1-95-90 | VK | 0.5 | | |
| ABT1-95-91 | VK | 0.3 | | |
| ABT1-95-92 | VK | <0.1 | 0.5 | |
| ABT1-95-93 | VK | 0.1 | | |
| ABT1-95-94 | VK | 0.1 | | |
| ABT1-95-95 | VK | 0.3 | | |
| ABT1-95-96 | VK | 0.1 | | |
| ABT1-95-97 | VK | | | |
| ABT1-95-98 | VK | 0.8 | | |
| ABT1-95-99 | VK | | | |
| ABT1-95-100 | VK | | | |
| ABT1-95-101 | VK | 0.5 | | |
| ABT1-95-102 | VK | 0.1 | 0.184 | |
| ABT1-95-103 | VK | | | |
| ABT1-95-104 | VK | | | |
| ABT1-95-105 | VK | 0.1 | | |
| ABT1-95-106 | VK | 0.1 | | |
| ABT1-95-107 | VK | 0.1 | 0.5 | |
| ABT1-95-108 | VK | 0.5 | | |
| ABT1-95-109 | VK | | | |
| ABT1-95-110 | VK | 0.1 | | |
| ABT1-95-111 | VK | <0.1 | | |
| ABT1-95-112 | VK | 0.1 | | |
| ABT1-95-113 | VK | <0.1 | | |
| ABT1-95-114 | VK | 0.2 | | |
| ABT1-95-115 | VK | 0.2 | 0.230 | |
| ABT1-95-116 | VK | 0.2 | 0.168 | |
| ABT1-95-117 | VK | 0.2 | 0.1 | |
| ABT1-95-118 | VK | 0.2 | 0.122 | |
| ABT1-95-119 | VK | | | |
| ABT1-95-120 | VK | 0.1 | 0.1 | |
| ABT1-95-121 | VK | 0.2 | 0.1 | |
| ABT1-95-122 | VK | 0.1 | 0.116 | |
| ABT1-95-123 | VK | 0.1 | | |
| ABT1-95-124 | VK | 0.2 | | |
| ABT1-95-125 | VK | 0.2 | | |
| ABT1-95-126 | VK | 0.8 | | |
| ABT1-95-127 | VK | 0.1 | | |
| ABT1-95-128 | VK | >1 | | |
| ABT1-95-129 | VK | >10 | | |
| ABT1-95-130 | VK | >1 | | |
| ABT1-95-131 | VK | 0.1 | 0.085 | |
| ABT1-95-132 | VK | 0.1 | 2 | |
| ABT1-95-133 | VK | | 0.050 | |
| ABT1-95-134 | VK | | 0.075 | |
| ABT1-95-135 | VK | | 0.1 | |
| ABT1-95-136 | VK | | 0.1 | |
| ABT1-95-137 | VK | | 0.09 | |
| ABT1-95-139 | VK | 0.2 | 0.1 | |
| ABT1-95-140 | VK | 0.2 | | |
| ABT1-95-141 | VK | 1 | | |
| ABT1-95-142 | VK | 0.5 | | |
| ABT1-95-143 | VK | 10 | | |
| ABT1-95-144 | VK | 0.5 | | |
| ABT1-95-145 | VK | 0.8 | | |
| ABT1-95-146 | VK | 0.8 | | |
| ABT1-95-147 | VK | 0.2 | | |
| ABT1-95-148 | VK | 0.2 | 0.190 | |
| ABT1-95-149 | VK | 0.2 | 0.064 | |
| ABT1-95-150 | VK | 0.2 | | |
| ABT1-95-151 | VK | 0.2 | | |
| ABT1-95-152 | VK | 0.8 | | |
| ABT1-95-153 | VK | 0.5 | | |
| ABT1-95-154 | VK | >10 | | |
| ABT1-95-155 | VK | 10 | | |
| ABT1-95-156 | VK | 10 | | |
| ABT1-95-157 | VK | 10 | | |
| ABT1-95-158 | VK | 0.5 | | |
| ABT1-95-159 | VK | 0.1 | 0.127 | |
| ABT1-95-160 | VK | 0.1 | 0.238 | |
| ABT1-95-161 | VK | 0.1 | 0.5 | |
| ABT1-95-162 | VK | | 0.186 | |
| ABT1-95-163 | VK | | 0.05 | |
| ABT1-95-164 | VK | | 0.150 | |
| ABT1-95-165 | VK | | 0.391 | |
| ABT1-95-166 | VK | | 0.035 | |
| ABT1-95-167 | VK | | 0.469 | |
| ABT1-95-168 | VK | | 2.3 | |
| ABT1-95-169 | VK | | 0.093 | |
| ABT1-95-170 | VK | | 0.2 | |
| ABT1-95-171 | VK | | 0.059 | |
| ABT1-95-172 | VK | | 0.171 | |
| ABT1-95-173 | VK | | 0.151 | |
| ABT1-95-174 | VK | | 0.01 | |
| ABT1-95-175 | VK | | 0.017 | |
| ABT1-95-176 | VK | | 0.027 | |
| ABT1-95-177 | VK | | 0.008 | |
| ABT1-95-178 | VK | | 0.004 | |
| ABT1-95-179 | VK | | 0.022 | |
| ABT1-95-181 | VK | | 0.014 | |
| ABT1-95-182 | VK | | 0.005 | |
| ABT1-95-183 | VK | | | |
| ABT1-95-184 | VK | | 0.006 | |
| ABT1-95-500 | VK | | | |
| ABT1-95-501 | VK | | | |
| ABT1-95-502 | VK | | | |
| ABT1-95-503 | VK | | | |
| ABT1-95-A1 | VK | | | |
| ABT1-95-A2 | VK | | 0.133 | |
| ABT1-95-A3 | VK | | 0.011 | |
| ABT1-95-A5 | VK | | 0.016 | |
| ABT1-95-A6 | VK | | 0.024 | |
| ABT1-96 | VH | | 17 | |
| ABT1-97 | VH | | 3000 | |
| ABT1-98 | VH | | <100 | |
| ABT1-99 | VH | | 500 | |
| ABT1-101 | VH | | | |
| ABT1-102 | VH | | | |
| ABT1-103 | VH | | | |
| ABT1-104 | VH | | | |
| ABT1-105 | VH | | | |
| ABT1-106 | VH | | | |
| ABT1-109 | VH | >500 | | |
| ABT1-110 | VH | | | |
| ABT1-111 | VH | | | |
| ABT1-113 | VH | >500 | | |
| ABT1-117 | VH | >500 | | |
| ABT1-118 | VH | | | |
| ABT1-119 | VK | | | |
| ABT1-120 | VK | | | |
| ABT1-121 | VK | | | |
| ABT1-122 | VK | 80 | 100 | |
| ABT1-122-18 | VK | 5 | 7 | |
| ABT1-122-21 | VK | 80 | 100 | |
| ABT1-122-511 | VK | 10 | 18 | |
| ABT1-122-750X | VK | | 0.713 | |
| ABT1-123 | VK | >500 | | |
| ABT1-124 | VK | | | |
| ABT1-125 | VK | | | |
| ABT1-126 | VK | | | |
| ABT1-127 | VK | | | |
| ABT1-128 | VK | | | |
| ABT1-129 | VK | | | |
| ABT1-130 | VK | 300 | | |
| ABT1-131 | VK | 80 | | |
| ABT1-132 | VK | 300 | | |
| ABT1-133 | VK | | | |
| ABT1-134 | VK | | | |
| ABT1-135 | VK | | | |
| ABT1-136 | VK | | | |

TABLE 62-continued

ABT 1 dAbs

| Clone Name | dAb | IC$_{50}$ [nM] | ND$_{50}$ [nM] | K$_D$ [nM] |
|---|---|---|---|---|
| ABT1-137 | VH | 200 | | |
| ABT1-138 | VH | >500 | | |
| ABT1-139 | VH | 80 | | |
| ABT1-140 | VH | | | |
| ABT1-141 | VK | 50 | 142 | |
| ABT1-141-1 | VK | >100 | | |
| ABT1-141-2 | VK | 100 | | |
| ABT1-141-3 | VK | 80 | | |
| ABT1-141-6 | VK | 20 | | |
| ABT1-141-7 | VK | 10 | | |
| ABT1-141-8 | VK | 10 | | |
| ABT1-141-9 | VK | 10 | | |
| ABT1-141-10 | VK | 30 | | |
| ABT1-141-11 | VK | | | |
| ABT1-141-12 | VK | | | |
| ABT1-141-13 | VK | | | |
| ABT1-141-14 | VK | 10 | | |
| ABT1-141-15 | VK | 50 | | |
| ABT1-141-16 | VK | 20 | | |
| ABT1-141-17 | VK | 30 | | |
| ABT1-141-18 | VK | 80 | | |
| ABT1-141-19 | VK | 50 | | |
| ABT1-141-20 | VK | 10 | | |
| ABT1-141-21 | VK | 60 | | |
| ABT1-141-22 | VK | 30 | | |
| ABT1-141-23 | VK | 80 | | |
| ABT1-141-24 | VK | | | |
| ABT1-141-25 | VK | 3 | 5 | |
| ABT1-141-27 | VK | 20 | | |
| ABT1-141-28 | VK | 200 | | |
| ABT1-141-29 | VK | | 20 | |
| ABT1-141-30 | VK | 40 | | |
| ABT1-141-31 | VK | | 2 | |
| ABT1-141-32 | VK | | 10 | |
| ABT1-141-33 | VK | | 3 | |
| ABT1-141-34 | VK | | 30 | |
| ABT1-141-35 | VK | 10 | | |
| ABT1-141-42 | VK | 3 | 5 | |
| ABT1-141-43 | VK | 3 | 5 | |
| ABT1-141-44 | VK | 3 | 5 | |
| ABT1-141-45 | VK | 100 | 100 | |
| ABT1-141-46 | VK | 3 | 1 | |
| ABT1-141-47 | VK | 1 | 1 | |
| ABT1-141-48 | VK | 3 | 1 | |
| ABT1-141-49 | VK | 3 | 5 | |
| ABT1-141-50 | VK | 10 | 20 | |
| ABT1-141-51 | VK | 10 | 20 | |
| ABT1-141-52 | VK | 100 | 100 | |
| ABT1-141-53 | VK | 50 | 10 | |
| ABT1-141-54 | VK | 3 | 5 | |
| ABT1-141-70 | VK | 1 | 1 | |
| ABT1-141-75 | VK | 3 | 5 | |
| ABT1-141-76 | VK | 1 | 1 | |
| ABT1-141-77 | VK | 3 | 1 | |
| ABT1-141-78 | VK | 3 | 0.7 | |
| ABT1-141-79 | VK | 3 | 2.4 | |
| ABT1-141-80 | VK | 3 | 1.7 | |
| ABT1-141-500 | VK | | | |
| ABT1-141-501 | VK | | | |
| ABT1-141-502 | VK | | | |
| ABT1-141-503 | VK | | | |
| ABT1-141-504 | VK | | | |
| ABT1-141-505 | VK | | | |
| ABT1-141-506 | VK | | | |
| ABT1-141-507 | VK | | | |
| ABT1-141-508 | VK | | | |
| ABT1-141-509 | VK | | | |
| ABT1-141-510 | VK | | | |
| ABT1-141-511 | VK | | | |
| ABT1-141-512 | VK | | | |
| ABT1-141-513 | VK | | | |
| ABT1-141-514 | VK | | | |
| ABT1-141-516 | VK | | | |
| ABT1-141-519 | VK | | | |
| ABT1-141-520 | VK | | | |
| ABT1-141-521 | VK | | | |
| ABT1-141-522 | VK | | | |
| ABT1-141-523 | VK | | | |
| ABT1-141-524 | VK | | | |
| ABT1-141-525 | VK | | | |
| ABT1-141-526 | VK | | | |
| ABT1-141-527 | VK | | | |
| ABT1-141-528 | VK | | | |
| ABT1-141-529 | VK | | | |
| ABT1-141-530 | VK | | | |
| ABT1-141-531 | VK | | 1 | |
| ABT1-141-532 | VK | | 2 | |
| ABT1-141-533 | VK | | | |
| ABT1-141-534 | VK | | | |
| ABT1-141-535 | VK | | | |
| ABT1-141-536 | VK | | | |
| ABT1-141-537 | VK | | | |
| ABT1-141-538 | VK | | | |
| ABT1-141-539 | VK | | | |
| ABT1-141-541 | VK | | | |
| ABT1-141-542 | VK | | | |
| ABT1-141-543 | VK | | | |
| ABT1-141-544 | VK | | | |
| ABT1-141-545 | VK | | | |
| ABT1-141-546 | VK | | | |
| ABT1-141-547 | VK | | | |
| ABT1-141-548 | VK | | | |
| ABT1-141-549 | VK | | | |
| ABT1-141-550 | VK | | | |
| ABT1-141-551 | VK | | | |
| ABT1-141-552 | VK | | | |
| ABT1-141-553 | VK | | | |
| ABT1-141-554 | VK | | | |
| ABT1-141-555 | VK | | | |
| ABT1-141-556 | VK | | | |
| ABT1-141-557 | VK | | | |
| ABT1-141-558 | VK | | | |
| ABT1-141-559 | VK | | | |
| ABT1-141-561 | VK | | | |
| ABT1-141-562 | VK | | >10 | |
| ABT1-141-563 | VK | | | |
| ABT1-141-564 | VK | | | |
| ABT1-141-565 | VK | | | |
| ABT1-141-567 | VK | | | |
| ABT1-141-568 | VK | | | |
| ABT1-141-569 | VK | | | |
| ABT1-141-572 | VK | | | |
| ABT1-141-573 | VK | | | |
| ABT1-141-574 | VK | | | |
| ABT1-142 | VK | 200 | | |
| ABT1-143 | VK | >500 | | |
| ABT1-144 | VK | 100 | | |
| ABT1-145 | VK | >500 | | |
| ABT1-146 | VK | >500 | | |
| ABT1-147 | VH | >500 | 300 | |
| ABT1-148 | VK | 400 | 100 | |
| ABT1-149 | VK | 100 | 100 | |
| ABT1-150 | VK | 150 | | |
| ABT1-151 | VK | 200 | | |
| ABT1-152 | VK | 300 | | |
| ABT1-153 | VK | 300 | | |
| ABT1-154 | VK | >1000 | | |
| ABT1-155 | VK | 20 | 20 | |
| ABT1-156 | VK | | | |
| ABT1-157 | VK | 300 | | |
| ABT1-158 | VK | 2 | <100 | |
| ABT1-159 | VK | 200 | | |
| ABT1-160 | VK | 300 | | |
| ABT1-161 | VK | >1000 | 8 | |
| ABT1-162 | VK | 1000 | 6.2 | |
| ABT1-163 | VK | 1000 | 105 | |
| ABT1-164 | VK | >1000 | 14 | |
| ABT1-165 | VK | >1000 | 1000 | |
| ABT1-166 | VK | >1000 | | |
| ABT1-167 | VK | >1000 | | |

TABLE 62-continued

ABT 1 dAbs

| Clone Name | dAb | IC$_{50}$ [nM] | ND$_{50}$ [nM] | K$_D$ [nM] |
|---|---|---|---|---|
| ABT1-168 | VK | >1000 | | |
| ABT1-169 | VK | 1000 | | |
| ABT1-170 | VK | >1000 | | |
| ABT1-171 | VK | >1000 | | |
| ABT1-172 | VK | >1000 | | |
| ABT1-221 | VK | | 100 | |

TABLE 63

ABT2 dAbs

| Clone Name | dAb | IC$_{50}$ [nM] | ND$_{50}$ [nM] | K$_D$ [nM] |
|---|---|---|---|---|
| ABT2-6 | VK | | >20000 | |
| ABT2-7 | VK | | >20000 | |
| ABT2-8 | VK | | >20000 | |
| ABT2-10 | VH | | 6000 | |
| ABT2-11 | VH | | >10000 | |
| ABT2-12 | VH | | | |
| ABT2-13 | VH | 175 | 1000 | |
| ABT2-14 | VH | | | |
| ABT2-15 | VH | | | |
| ABT2-16 | VH | | | |
| ABT2-17 | VH | | | |
| ABT2-19 | VH | | | |
| ABT2-20 | VH | | | |
| ABT2-21 | VH | | | |
| ABT2-22 | VH | | | |
| ABT2-23 | VH | 5000 | | |
| ABT2-24 | VH | 2000 | | |
| ABT2-25 | VH | | | |
| ABT2-26 | VH | | | |
| ABT2-27 | VH | | | |
| ABT2-28 | VH | | | |
| ABT2-29 | VH | | | |
| ABT2-30 | VH | | | |
| ABT2-31 | VH | | | |
| ABT2-32 | VH | 1000 | | |
| ABT2-33 | VH | | | |
| ABT2-35 | VH | | >10000 | |
| ABT2-36 | VH | | | |
| ABT2-37 | VH | | | |
| ABT2-38 | VH | | | |
| ABT2-39 | VH | | >10000 | |
| ABT2-40 | VH | | | |
| ABT2-41 | VH | | | |
| ABT2-42 | VK | 770 | | |
| ABT2-43 | VK | | >10000 | |
| ABT2-44 | VK | | | |
| ABT2-46 | VK | 390 | | |
| ABT2-53 | VK | | | |
| ABT2-54 | VK | | | |
| ABT2-55 | VK | | | |
| ABT2-56 | VK | | | |
| ABT2-57 | VK | | | |
| ABT2-58 | VK | | | |
| ABT2-59 | VK | 700 | >1000 | |
| ABT2-60 | VK | 1000 | >1000 | |
| ABT2-61 | VK | 1000 | >1000 | |
| ABT2-62 | VK | 1000 | >1000 | |
| ABT2-63 | VK | 1000 | | |
| ABT2-64 | VH | | >10000 | |
| ABT2-65 | VH | 100 | 505 | |
| ABT2-65-1 | VH | 100 | | |
| ABT2-65-2 | VH | 20 | | |
| ABT2-65-7 | VH | 30 | 200 | |
| ABT2-65-8 | VH | 10 | 3 | |
| ABT2-65-9 | VH | 100 | | |
| ABT2-65-10 | VH | 20 | | |
| ABT2-65-11 | VH | 50 | | |
| ABT2-65-12 | VH | 20 | | |

TABLE 63-continued

ABT2 dAbs

| Clone Name | dAb | IC$_{50}$ [nM] | ND$_{50}$ [nM] | K$_D$ [nM] |
|---|---|---|---|---|
| ABT2-65-13 | VH | 20 | | |
| ABT2-65-14 | VH | 1000 | | |
| ABT2-65-15 | VH | 100 | | |
| ABT2-65-16 | VH | 200 | | |
| ABT2-65-17 | VH | 2.5 | 5 | |
| ABT2-65-18 | VH | 20 | | |
| ABT2-65-19 | VH | >1000 | | |
| ABT2-65-20 | VH | >1000 | | |
| ABT2-65-21 | VH | >1000 | | |
| ABT2-65-22 | VH | 100 | | |
| ABT2-65-23 | VH | 800 | | |
| ABT2-65-24 | VH | 50 | | |
| ABT2-65-25 | VH | 4 | | |
| ABT2-65-26 | VH | 20 | | |
| ABT2-65-27 | VH | 3.5 | | |
| ABT2-65-28 | VH | 5 | | |
| ABT2-65-29 | VH | 20 | | |
| ABT2-65-30 | VH | 20 | | |
| ABT2-65-31 | VH | 3 | | |
| ABT2-65-32 | VH | 4 | | |
| ABT2-65-33 | VH | 20 | | |
| ABT2-65-34 | VH | | 20 | |
| ABT2-65-35 | VH | | 4 | |
| ABT2-65-36 | VH | >1000 | | |
| ABT2-65-37 | VH | 100 | | |
| ABT2-65-38 | VH | 30 | | |
| ABT2-65-39 | VH | 300 | | |
| ABT2-65-40 | VH | | | |
| ABT2-65-41 | VH | >1000 | | |
| ABT2-65-42 | VH | >1000 | | |
| ABT2-65-43 | VH | | | |
| ABT2-65-44 | VH | >1000 | | |
| ABT2-65-45 | VH | >1000 | | |
| ABT2-65-46 | VH | 30 | | |
| ABT2-65-47 | VH | 20 | 80 | |
| ABT2-65-48 | VH | 20 | 80 | |
| ABT2-65-49 | VH | 20 | | |
| ABT2-65-50 | VH | | | |
| ABT2-65-51 | VH | | | |
| ABT2-65-52 | VH | | | |
| ABT2-65-53 | VH | | | |
| ABT2-65-54 | VH | | | |
| ABT2-65-55 | VH | | | |
| ABT2-65-56 | VH | | | |
| ABT2-65-57 | VH | | | |
| ABT2-65-58 | VH | | | |
| ABT2-65-59 | VH | | | |
| ABT2-65-6 | VH | 30 | >1000 | |
| ABT2-65-60 | VH | | | |
| ABT2-65-61 | VH | | | |
| ABT2-65-62 | VH | | | |
| ABT2-65-63 | VH | | | |
| ABT2-65-64 | VH | | | |
| ABT2-65-65 | VH | | | |
| ABT2-65-66 | VH | | | |
| ABT2-65-67 | VH | | | |
| ABT2-65-68 | VH | | | |
| ABT2-65-69 | VH | | | |
| ABT2-65-70 | VH | | | |
| ABT2-65-71 | VH | | | |
| ABT2-65-72 | VH | | | |
| ABT2-65-73 | VH | | | |
| ABT2-65-74 | VH | >1000 | | |
| ABT2-65-75 | VH | 30 | | |
| ABT2-65-76 | VH | 8 | | |
| ABT2-65-77 | VH | 50 | | |
| ABT2-65-78 | VH | 30 | | |
| ABT2-65-79 | VH | 6 | 2 | |
| ABT2-65-80 | VH | 7 | 0.5 | |
| ABT2-65-81 | VH | 10 | 2 | |
| ABT2-65-82 | VH | 8 | 2 | |
| ABT2-65-83 | VH | 300 | | |
| ABT2-65-84 | VH | 60 | | |
| ABT2-65-85 | VH | 7 | 2 | |
| ABT2-65-86 | VH | >1000 | | |

TABLE 63-continued

ABT2 dAbs

| Clone Name | dAb | IC$_{50}$ [nM] | ND$_{50}$ [nM] | K$_D$ [nM] |
|---|---|---|---|---|
| ABT2-65-87 | VH | 50 | | |
| ABT2-65-88 | VH | 20 | | |
| ABT2-65-89 | VH | 10 | 2 | |
| ABT2-65-90 | VH | 300 | | |
| ABT2-65-113 | VH | 3.3 | 3 | |
| ABT2-65-114 | VH | 4 | | |
| ABT2-65-115 | VH | 4 | | |
| ABT2-65-116 | VH | | | |
| ABT2-65-117 | VH | 10 | | |
| ABT2-65-118 | VH | 4.6 | | |
| ABT2-65-119 | VH | 4 | | |
| ABT2-65-120 | VH | 4.2 | | |
| ABT2-65-121 | VH | 3.9 | | |
| ABT2-65-122 | VH | 3.8 | | |
| ABT2-65-123 | VH | | | |
| ABT2-65-124 | VH | 3.8 | | |
| ABT2-65-125 | VH | 4 | | |
| ABT2-65-126 | VH | 4.3 | | |
| ABT2-65-127 | VH | 5.5 | | |
| ABT2-65-128 | VH | | | |
| ABT2-65-129 | VH | 3.4 | | |
| ABT2-65-130 | VH | 4.3 | | |
| ABT2-65-131 | VH | 13.2 | | |
| ABT2-65-132 | VH | 5 | | |
| ABT2-65-133 | VH | 30 | | |
| ABT2-65-134 | VH | | | |
| ABT2-65-135 | VH | 5 | | |
| ABT2-65-136 | VH | | | |
| ABT2-65-137 | VH | 5 | | |
| ABT2-65-138 | VH | 5 | | |
| ABT2-65-139 | VH | 4 | | |
| ABT2-65-140 | VH | 2 | 1 | |
| ABT2-65-141 | VH | 5 | | |
| ABT2-65-142 | VH | | | |
| ABT2-65-143 | VH | 5 | | |
| ABT2-65-144 | VH | 6 | | |
| ABT2-65-145 | VH | 5 | | |
| ABT2-65-146 | VH | 6 | | |
| ABT2-65-147 | VH | | | |
| ABT2-65-148 | VH | 4 | | |
| ABT2-65-149 | VH | 4 | | |
| ABT2-65-150 | VH | | | |
| ABT2-65-151 | VH | 6 | | |
| ABT2-65-152 | VH | 5 | | |
| ABT2-65-154 | VH | 3 | 1.5 | |
| ABT2-65-155 | VH | 5 | | |
| ABT2-65-156 | VH | 5 | | |
| ABT2-65-157 | VH | | | |
| ABT2-65-158 | VH | 5 | | |
| ABT2-65-159 | VH | 5 | | |
| ABT2-65-160 | VH | | 2 | |
| ABT2-65-163 | VH | | 2 | |
| ABT2-65-166 | VH | 4 | 4 | |
| ABT2-65-167 | VH | 30 | | |
| ABT2-65-168 | VH | 30 | | |
| ABT2-65-169 | VH | 9 | | |
| ABT2-65-170 | VH | 10 | | |
| ABT2-65-171 | VH | 7.5 | | |
| ABT2-65-172 | VH | 6 | | |
| ABT2-65-173 | VH | 30 | | |
| ABT2-65-174 | VH | 10 | | |
| ABT2-65-175 | VH | 10 | | |
| ABT2-65-176 | VH | 5 | | |
| ABT2-65-177 | VH | 20 | | |
| ABT2-65-500 | VH | | | |
| ABT2-65-501 | VH | | | |
| ABT2-65-502 | VH | | 2 | |
| ABT2-65-503 | VH | | | |
| ABT2-65-504 | VH | | 4 | |
| ABT2-65-505 | VH | | | |
| ABT2-65-506 | VH | | | |
| ABT2-65-507 | VH | | | |
| ABT2-65-508 | VH | | | |
| ABT2-65-509 | VH | | | |
| ABT2-65-510 | VH | | 1 | |
| ABT2-65-511 | VH | | | |
| ABT2-65-512 | VH | | 3 | |
| ABT2-65-513 | VH | | | |
| ABT2-65-514 | VH | | | |
| ABT2-65-515 | VH | | | |
| ABT2-66 | VH | | >10000 | |
| ABT2-67 | VH | | >10000 | |
| ABT2-68 | VK | | >10000 | |
| ABT2-69 | VH | | >10000 | |
| ABT2-70 | VH | | | |
| ABT2-71 | VH | | | |
| ABT2-72 | VH | | >10000 | |
| ABT2-73 | VH | | | |
| ABT2-74 | VH | | | |
| ABT2-75 | VH | | | |
| ABT2-76 | VK | | 500 | |
| ABT2-77 | VK | | | |
| ABT2-79 | VK | | | |
| ABT2-80 | VK | >500 | | |
| ABT2-81 | VK | | | |
| ABT2-83 | VK | | | |
| ABT2-84 | VK | | | |
| ABT2-85 | VK | | | |
| ABT2-86 | VK | >500 | | |
| ABT2-87 | VK | | | |
| ABT2-88 | VK | | | |
| ABT2-89 | VK | | | |
| ABT2-90 | VK | | | |
| ABT2-91 | VK | >500 | | |
| ABT2-93 | VK | >500 | | |
| ABT2-94 | VK | >500 | | |
| ABT2-95 | VK | >500 | | |
| ABT2-96 | VK | >500 | | |
| ABT2-97 | VK | >500 | | |
| ABT2-98 | VK | >500 | | |
| ABT2-99 | VH | >500 | | |
| ABT2-101 | VH | >500 | | |
| ABT2-104 | VH | >500 | | |
| ABT2-105 | VH | >500 | | |
| ABT2-106 | VH | >500 | | |
| ABT2-107 | VH | >500 | | |
| ABT2-108 | VH | 70 | | |
| ABT2-108-533X | VH | | 5 | |
| ABT2-108-534X | VH | | | |
| ABT2-108-537X | VH | | 206 | |
| ABT2-108-538X | VH | | 5 | |
| ABT2-108-620X | VH | | | |

TABLE 64

DNA sequences for ABT1 and ABT2 dAbs

| dAb Name | DNA sequence |
|---|---|

ABT1 VH dAbs

ABT1-6    GAGGTGCAGCTGTTGGAGTCTGGGGGAGGCTTGGTACAGCCTGGGGGGTCCCTGCGTCTCTC
CTGTGCAGCCTCCGGATTCACCTTTGGGCTTATGATATGCAGTGGGTCCGCCAGGCTCCAG

TABLE 64-continued

DNA sequences for ABT1 and ABT2 dAbs

| dAb Name | DNA sequence |
|---|---|
| | GGAAGGGTCTAGAGTGGGTCTCAAGTATTAATAAGTCTGGTGCTTTGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTTGGGCGTCTTTTG<br>ACTACTGGGGCCAGGGAACCCTGGTCACCGTCTCGAGC (SEQ ID NO: 134) |
| ABT1-6-3 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCTTATGATATGCAGTGGGTCCGCCAGGCTCCAG<br>GCAAGGGTCTAGAGTGGGTCTCAAGTATTTATAAGTCTGGTGCTTTGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTTGGGCGTCTTTTG<br>ACTACTGGGGCCAGGGAACCCTGGTCACCGTCTCGAGC (SEQ ID NO: 135) |
| ABT1-6-23 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGTACGCTATGACATGGCATGGGTCCGCCAGGCTCCAG<br>GgAAGGGTCTAGAGTGGGTCTCAAGTATTTATAAGTCTGGTGCTTTGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTTGGGCGTCTTTTG<br>ACTACTGGGGCCAGGGAACCCTGGTCACCGTCTCGAGC (SEQ ID NO: 136) |
| ABT1-7 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGCGGTATCGGATGCAGTGGGTCCGCCAGGCTCCAG<br>GGAAGGGTCTAGAGTGGGTCTCATCTATTAGTTGGGAGGGTACGAGGACACTTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGTGACTCAGAAGGGTT<br>TGTTGAATTTTGACTACTGGGGCCAGGGAACCCTGGTCACCGTCTCGAGC (SEQ ID NO:<br>137) |
| ABT1-8 | GAGGTGCAGCTGTTGGAGTCTGGGGGAGGCTTGGTACAGCCTGGGGGGTCCCTGCGTCTCTC<br>CTGTGCAGCCTCCGGATTCACCCTTAAGGCGTATAATATGTGTGGGTCCGCCAGGCTCCAG<br>GGAAGGGTCTAGAGTGGGTCTCACTGATTAGTAGTACGGGTATGTTTACAGATTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATGGGGGGTTAGGCGGG<br>GGCTTTATTTTGACTACTGGGGCCAGGGAACCCTGGTCACCGTCTCGAGC (SEQ ID NO:<br>138) |
| ABT1-15 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCGGTATCGGATGCAGTGGGTCCGCCAGGCTCCAG<br>GGAAGGGTCTAGAGTGGGTCTCAAGTATTAATAAGTCTGGTGCTTTGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTTGGGCGTCTTTTG<br>ACTACTGGGGCCAGGGAACCCTGGTCACCGTCTCGAGC (SEQ ID NO: 139) |
| ABT1-17 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGCGGTATCGGATGCCGTGGGTCCGCCAGGCTCCAG<br>GGAAGGGTCTAGAGTGGGTCTCATCTATTAGTTGGGAGGGTACGAGGACACTTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGTGACTCAAAAGGGTT<br>TGCTGAATTTTGACTACTGGGGCCAGGGAACCCTGGTCACCGTCTCGAGC (SEQ ID NO:<br>140) |
| ABT1-19 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCCTGTTTATAGTATGCCTTGGGTCCGCCAGGCTCCAG<br>GGAAGGGTCTAGAGTGGGTCTCACTGATTCCGTGGCCTGGTTTGAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGAGACGTCTAATTTTG<br>ACTACTGGGGTCAGGGAACCCTGGTCACCGTCTCGAGC (seq id no: 141) |
| ABT1-20 | GAGGTGCAGCTGTTGGAGACTGGGGGAGGCTTGGTACAGCCTGGGGGGTCCCTGCGTCTCTC<br>CTGTGCAGCCTCCGGATTCACCTTTACGCCTTATCGGATGGGTGGGTCCGCCAGGCTCCAG<br>GGAAGGGTCTAGAGTGGGTCTCACATATTGGGATTTGGGGTGCTAATACATACTACGCAGAC<br>TCCGTGAAGGGCCGGTTCACCATCTCCCGCGACAATTCCAAGAACACGCTGTATCTGCAAAT<br>GAACAGCCTGCGCGCCGAGGACACCGCGGTATATTACTGTGCGAAACATCCGAGGCCTTTTG<br>ACTACTGGGGTCAGGGAACCCTGGTCACCGTCTCGAGC (seq id no: 142) |
| ABT1-21 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGCCGTATGCGATGACTTGGGTCCGCCAGGCTCCAG<br>GGAAGGGTCTAGAGTGGGTCTCAACTATTGGGCGGACGGGTACTCGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGGCGGCGGAGGTTTG<br>ACTACTGGGGTCAGGGAACCCTGGTCACCGTCTCGAGC (seq id no: 143) |
| ABT1-22 | GAGGTGCAGCTGTTGGAGTCTGGGGGAGGCTTGGTACAGCCTGGGGGGTCCCTGCGTCTCTC<br>CTGTGCAGCCTCCGGATTCACCCTTAAGGCGTATAATATGTCGTGGGTCCGCCAGGCTCCAG<br>GGAAGGGTCTAGAGTGGGTCTCACTGATTAGTAGTACGGGTATGTTTACAGATTACGCAGAC<br>TCCGTGAAGGGCCGGTTCACCATCTCCCGCGACAATTCCAAGAACACGCTGTATCTGCAAAT |

TABLE 64-continued

DNA sequences for ABT1 and ABT2 dAbs

| dAb Name | DNA sequence |
| --- | --- |
|  | GAACAGCCTGCGTGCCGAGGACACCGCGGTATATTACTGTGCGAAATGGGGGGTTAGGCGGG<br>GGCTTTATTTTGACTACTGGGGCCAGGGAACCCTGGTCACCGTCTCGAGC (seq id no: 144) |
| ABT1-23 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCGTCGTATCCTATGGAGTGGGTCCGCCAGGCTCCAG<br>GGAAGGGTCTAGAGTGGGTCTCAGCGATTGCGTGGCCGGGTAGTATGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACGCATCGGCTTTTTG<br>ACTACTGGGGTCAGGGAACCCTGGTCACCGTCTCGAGC (seq id no: 145) |
| ABT1-31 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGCAGCTATGCCATGAGCTGGGTCCGCCAGGCTCCAG<br>GGAAGGGTCTAGAGTGGGTCTCAGGTATTAATCGGTCTGGTACGCGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAGGATTCGTCATTTTG<br>ACTACTGGGGTCAGGGAACCCTGGTCACCGTCTCGAGC (seq id no: 146) |
| ABT1-32 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCCTGATTATGATATGAAGTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAACTCCAAGAACACGCTGTATCTGCAAAT<br>GAACAGCCTGCGTGCCGAGGACACCGCTGTATATTACTGTGCGAAAATTGTTGGTTTTGCGT<br>GGGATTATTTTGACTACTGGGGCCAGGGAACCCTGGTCACCGTCTCGAGC (seq id no: 147) |
| ABT1-33 | GAGGTGCAGCTGTTGGAGTCTGGGGGAGGCTTGGTACAGCCTGGGGGGTCCCTGCGTCTCTC<br>CTGTGCAGCCTCCGGATACACCTTTAGGAGTTATAGTATGAATTGGGTCCGCCAGGCTCCAG<br>GGAAGGGTCTAGAGTGGGTCTCAGCGATTAGTCCGCATGGTACGTATACAAAGTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACGGCGTATTCGTTCTT<br>CGGGTTTTTTTGACTACTGGGGCCAGGGAACCCTGGTCACCGTCTCGAGC(seq id no: 148) |
| ABT1-34 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTAGGTATTCGATGAGTTGGGTCCGCCAGGCTCCAG<br>GGAAGGGTCTAGAGTGGGTCTCAATGATTGCTCCTGCGGGTAGGATGACATTGTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACGGGTTTGACTCGGA<br>GGACGCGGTTTGACTACTGGGGCCAGGGAACCCTGGTCACCGTCTCGAGC (seq id no: 149) |
| ABT1-35 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAAGTTGTATGAGATGGAGTGGGTCCGCCAGGCTCCAG<br>GGAAGGGTCTAGAGTGGGTCTCACGGATTGATAGTATGGGTGGGATTACAGAGTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACTGAGCTTCCTTATC<br>CTTCGGCTTTTGACTACTGGGGCCAGGGAACCCTGGTCACCGTCTCGAGC (seq id no: 150) |
| ABT1-36 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGCAGCTATGCCATGAGCTGGGTCCGCCAGGCTCCAG<br>GGAAGGGTCTAGAGTGGGTCTCATCTATTTCGTCGGGTGGTAGTGCTACAGCGTACGCAGAC<br>TCCGTGATGGGCCGGTTCACCATCTCCCGCGACAATTCCAAGAACACGCTGTATCTGCAAAT<br>GAACAGCCTGCGTGCCGAGGACGCCGCGGTATATTACTGTGCGAAAAGGTCTTATCTGTTTG<br>ACTACTGGGGCCAGGGAACCCTGGTCACCGTCTCGAGC (seq id no: 151) |
| ABT1-37 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCATGATTATGATATGAAGTGGGTCCGCCAGGCTCCAG<br>GGAAGGGTCTAGAGTGGGTCTCATGGATTTCGTTTGATGGTGCTCGGACATTTTACGCAGAC<br>TCCGTGCAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGAGGAGACGGGTTTTG<br>ACTACTGGGGCCAGGGAACCCTGGTCACCGTCTCGAGC (seq id no: 152) |
| ABT1-38 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGCAGTATCGGATGGGTGGGTCCGCCAGGCTCCAG<br>GGAGGGGTCTAGAGTGGGTCTCACGGATTGAGAGTGATGGTGCGGAGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACCTGATTGGATTTTG<br>ACTACAGGGGCCAGGGAACCCTGGTCACCGTCTCGAGC (seq id no: 153) |
| ABT1-40 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCCTATTTATTTTATGGTTTGGGTCCGCCAGGCTCCAG<br>GGAAGGGTCTAGAGTGGGTCTCACTGATTAGTAGTACGGGTATGTTTACAGATTACGCAGAC<br>TCCGTGAAGGGCCGGTTCACCATCTCCCGCGACAATTCCAAGAACACGCTGTATCTGCAAAT |

TABLE 64-continued

DNA sequences for ABT1 and ABT2 dAbs

| dAb Name | DNA sequence |
|---|---|
|  | GAACAGCCTGCGTGCCGAGGACACCGCGGTATATTACTGTGCAAATGGGGGGTTAGGCGGG<br>GGCTTTATTTTGACTACTGGGGCCAGGGAACCCTGGTCACCGTCTCGAGC (seq id no: 154) |
| ABT1-41 | GAGGTGCAGCTGTTGGAGTCTGGGGGAGGCTTGGTACAGCCTGGGGGTCCCTGCGTCTCTC<br>CTGTGCAGCCTCCGGATTCACCTTTCAGTATTATGTTATGGGTTGGGTCCGCCAGGCTCCAG<br>GGAAGGGTCTAGAGTGGGTCTCATGGATTGCTACGTATGGTAGTCATACATGGTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAACAGGGTAATCATCGTT<br>TGGGTCATTTTGACTACTGGGGCCAGGGAACCCTGGTCACCGTCTCGAGC (seq id no: 155) |
| ABT1-42 | GAGGTGCAGCTGTTGGAGTCTGGGGGAGGCTTGGTACAGCCTGGGGGTCCCTGCGTCTCTC<br>CTGTGCAGCCTCCGGATTCACCTTTGAGAAGTATGAGATGGCGTGGGTCCGCCAGGCTCCAG<br>GGAAGGGTCTAGAGTGGGTCTCAGCTATTGGGCCTATGGGTTTTGGTACAAATTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAATTTGGGAAGCATCCTC<br>CGGGTACTTTTGACTACTGGGGCCAGGGAACCCTGGTCACCGTCTCGAGC (seq id no: 156) |
| ABT1-43 | GAGGTGCAGCTGTTGGAGTCTGGGGGAGGCTTGGTACAGCCTGGGGGTCCCTGCGTCTCTC<br>CTGTGCAGCCTCCGGATTCACCTTTGAGAAGTATGAGATGGCGTGGGTCCGCCAGGCTCCAG<br>GGAAGGGTCTAGAGTGGGTCTCAGCTATTGGGCCTATGGGTTTTGGTACAAATTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAATTTGGGAAGCATCCTC<br>AGGGTACTTTTGACTACTGGGGCCAGGGAACCCTGGTCACCGTCTCGAGC (seq id no: 157) |
| ABT1-45 | GAGGTGCAGCTGTTGGAGTCTGGGGGAGGCTTGGTACAGCCTGGGGGTCCCTGCGCCTCTC<br>CTGTGCAGCCTCCGGATTCACCTTTCATAATTATAGGATGTTGTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAATCGGCGCCTATTCCGA<br>TGAGTATGTTTGACTACTGGGGCCAGGGAACCCTGGTCACCGTCTCGAGC (seq id no: 158) |
| ABT1-46 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGAATTATATGATGGATTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAACTGGGGCATCCGATGG<br>GTAATGGTTTTGACTACTGGGGCCAGGGAACCCTGGTCACCGTCTCGAGC (seq id no: 159) |
| ABT1-47 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCTTATGATATGCACTGGGTCCGCCAGGCTCCAG<br>GGAAGGGTCTAGAGTGGGTCTCATGTATTAATAAGTCTGGTGCTTTGACATCTTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAAGGTTGTTAGTCTTTTG<br>ACTACTGGGGCCAGGGAACCCTGGTCACCGTCTCGAGC (seq id no: 160) |
| ABT1-49 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAATTTGTATGCGATGAGGTGGGTCCGCCAGGCTCCAG<br>GGAAGGGTCTAGAGTGGGTCTCAGCTATTTCGCCGATGGGTAAGGGTACATATTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCAAAGTGGGGTATATTTTTG<br>ACTACTGGGGCCAGGGAACCCTGGTCACCGTCTCGAGC (seq id no: 161) |
| ABT1-50 | GAGGTGCAGCTGTTGGAGTCTGGGGGAGGCTTGGTACAGCCTGGGGGTCCCTGCGTCTCT<br>CCTGTGCAGCCACCGGATTCACCTTTAGCAGCTATGCCATGAGCTGGGTCCGCCAGGCTCC<br>AGGGAAGGGTCTAGAGTGGGTCTCATCTATTTCGTCGGTGGTAGTGCTACAGCGTACGCA<br>GACTCCGTGAAGGGCCGGTTCACCATCTCCCGCGACAATTCCAAGAACACGCTGTATCTGC<br>AAATGAACAGCCTGCGTGCCGAGGACACCGCGGTATATTACTGTGCGAAAGGTCTTATCT<br>GTTTGACTACTGGGGCCAGGGAACCCTGGTCACCGTCTCGAGC (SEQ ID NO: 162) |
| ABT1-51 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGCAGCTATGCCATGAGCTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGTGACAATTCCAAGAACACGCTGTATCTGCAAAT<br>GAACAGCCTGCGTGCCGAGGACACCGCGGTATATTACTGTGCAAAAGTTATGGTGCTTTTG<br>ACTACTGGGGCCAGGGAACCCTGGTCACCGTCTCGAGC (seq id no: 163) |
| ABT1-52 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGAGTTATCGGATGAGTTGGGTCCGCCAGGCTCCAG<br>GGAAGGGTCTAGAGTGGGTCTCAAGTATTTCTGCTATGGGTCGTCGTACACTTTACGCAGAC<br>TCCGTGAAGGGCCGGTTCACCATCTCCCGCGACAATTCCAAGAACACGCTGTATCTGCAAAT |

TABLE 64-continued

DNA sequences for ABT1 and ABT2 dAbs

| dAb Name | DNA sequence |
|---|---|
| | GAACAGCCTGCGTGCCGAGGACACCGCGGTATATTACTGTGCGAAAGTTGGGGCGCGTTTTG<br>ACTACTGGGGCCAGGGAACCCTGGTCACCGTCTCGAGC (seq id no: 164) |
| ABT1-75 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGCAGCTATGCCATGAGCTGGGTCCGCCAGGCTCCAG<br>GGAAGGGTCTAGAGTGGGTCTCAACGATTACTCCTGGTGGTTCTGGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAGGAAGTTTGCTTTTG<br>ACTACTGGGGTCAGGGAACCCTGGTCACCGTCTCGAGC (seq id no: 165) |
| ABT1-76 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCCTCTTTATGATATGTCGTGGGTCCGCCAGGCTCCAG<br>GGAAGGGTCTAGAGTGGGTCTCAAGGATTCGTGCGAATGGTGGTCGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACGGCGGCTTGGGTTA<br>AGGGTAATTTTGACTACTGGGGTCAGGGAACCCTGGTCACCGTCTCGAGC (seq id no:<br>166) |
| ABT1-77 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGTGCGTTATTCTATGCTGTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAACCTTCTAGGATGAGTC<br>TTAAGAAGTTTGACTACTGGGGTCAGGGAACCCTGGTCACCGTCTCGAGC (seq id no:<br>167) |
| ABT1-78 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCATTATACGATGACTTGGGTCCGCCAGGCTCCAG<br>GGAAGGGTCCAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAGTATTGAGCTGTCGG<br>GTGGGGCGTTTGACTACTGGGGCCAGGGAACCCTGGTCACCGTCTCGAGC (seq id no:<br>168) |
| ABT1-79 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCATATGGCTTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAAGGCTTCTGGTCGTC<br>GTTCGATGTTTGACTACTGGGGCCAGGGAACCCTGGTCACCGTCTCGAGC (seq id no:<br>169) |
| ABT1-81 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGCAGCTATGCCATGAGCTGGGTCCGCCAGGCTCCAG<br>GGAAGGGTCTAGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACTCGGGTGGCGCCGG<br>CTGTTCTGTTTGACTACCGGGGCCAGGGAACCCTGGTCACCGTCTCGAGC (seq id no:<br>170) |
| ABT1-84 | GAGGTGCAGCTGTCGGAGTCTGGGGGAGGCTTGGTACAGCCTGGGGGGTCCCTGCGTCTCTC<br>CTGTGCAGCCTCCGGATTCACCTTTAATGATTATAGGATGGTGTGGGCCCGCCAGGCTCCAG<br>GGAAGGGTCTAGAGTGGGTCTCAACTATTAGTAAGTCTGGTCGGACTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAATATACGATTCCGTTTG<br>ACTACTGGGGTCAGGGAACCCTGGTCACCGTCTCGAGC (seq id no: 171) |
| ABT1-85 | GAGGTGCAGCTGTTGGAGTCTGGGGGAGGCTTGGTACAGCCTGGGGGGTCCCTGCGTCTCTC<br>CTGTGCAGCCTCCGGACTCACCTTTAGTTTGTATGGGATGGCGTGGGCCCGCCAGGCTCCAG<br>GGAAGGGTCTAGAGTGGGTCTCAAGTATTTCGTCAGTGGTAGTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACAGCGTTGGTCTCATG<br>GTAGTGTGCTTGGTTTTGACTACTGGGGTCAGGGAACCCTGGTCACCGTCTCGAGC (seq<br>id no: 172) |
| ABT1-86 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATCGTTATATTATGCTTGGGTCCGCCAGGCTCCAG<br>GGAAGGGTCTGGAGTGGGTCTCATCGATTACTCCTAGTGGTGCTGCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGGAAGAGCTGCTGATAGGT<br>ATAGTACGTGGACTTTTGACTACTGGGGTCAGGGAACCCTGGTCACCGTCTCGAGC (seq<br>id no: 173) |
| ABT1-87 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCGTATAATATGAATTGGGTCCGCCAGGCTCCAG<br>GGAAGGGTCTAGAGTGGGTCTCAACTATTTCTGCTTCGGGTCGTTATACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACCATCTTCCGCGACAATTCCAAGAACACGCTGTATCTGCAAAT<br>GAACAGCCTGCGTGCCGAGGACACCGCGGTATATTACTGTGCGGAAGGGTTTATTTCTGTGG<br>ATGAGTATGTGCCGTATCATTTTGACTACTGGGGTCAGGGAACCCTGGTCACCGTCTCGAGC<br>(seq id no: 174) |
| ABT1-88 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGTTGTATAAGATGTCTTGGGTCCGCCAGGCTCCAG<br>GGAAGGGTCTAGAGTGGGTCTCAAGTATTAGTTCTAATGGTGAGGGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACTTTGTATCTGTGGG<br>GGTCGAGGCAGGCTTTTGACTACTGGGGTCAGGGAACCCTGGTCACCGTCTCGAGC (seq<br>id no: 175) |
| ABT1-89 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCGGTTGTATGGGATGAATTGGGTCCGCCAGGCTCCAG<br>GGAAGGGTCTAGAGTGGGTCTCAGCTATTTCTTCGGATGGTCAGAGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGGTGGTTGAGGGGTC<br>ATAATCTTATGCGGACGGAGTTTGACTACTGGGGTCAGGGAACCCTGGTCACCGTCTCGAGC<br>(seq id no: 176) |
| ABT1-90 | GAGGTGCAGCTGTTGGAGTCTGGGGGAGGCTTGGTACAGCCTGGGGGGTCCCTGCGTCTCT<br>CCTGTGCAGCCTCCGGATTCACCTTTCATGATTATTGGATGACGTGGGTCCGCCAGGCTCC<br>AGGGAAGGGTCTGGAGTGGGTCTCATCTATTTCTGCTTTGGGTGGTGCTACATACTACGCA<br>GACTCCGTGAAGGGCCGGTTCACCATCTCCCGCGACAATTCCAAGAACACGCTGTATCTGC<br>AAATGAACAGCCTGCGTGCCGAGGACACCGCGGTATATTACTGTGCGAAAGGGCTTCTTCG<br>GGAGCCGCAGTGGCGGCAGGGTTTTGACTACTGGGGTCAGGGAACCCTGGTCACCGTCTCG<br>AGC (SEQ ID NO: 177) |
| ABT1-91 | GAGGTGCAGCTGTTGGAGTCTGGGGGAGGCTTGGTACAGCCTGGGGGGTCCCTGCGTCTCTC<br>CTGTGCAGCCTCCGGATTCACCTTTACGGATTATACTATGATGTGGGTCCGCCAGGCTCCAG<br>GGAAGGGTCTAGAGTGGGTCTCAAGTATTGAGCGGATGGTCGGCGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAGGGCAGGCGAAGTTT<br>TTGACTACTGGGGTCAGGGAACCCTGGTCACCGTCTCGAGC (seq id no: 178) |
| ABT1-92 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTACGTATACTATGACTTGGGTCCGCCAGGCTCCAG<br>GGAAGGGTCTAGAGTGGGTCTCAACTATTTTCCTGGGGGTTCGACGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATGTTGATTTGTGA<br>AGTTGTCTTTTGACTACTGGGGTCAGAGAACCCTGGTCACCGTCTCGAGC (seq id no:<br>179) |
| ABT1-93 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAATGAGTATAATATGGTGTGGGTCCGCCAGGCTCCAG<br>GGAAGGGTCTAGAGTGGGTCTCAAGTATTTCTGGGGGTGGTGGTTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAACCTCTGAGGGGTTTG<br>TGTGTTCGCAGCATTGTTCTTTTGACTACTGGGGTCAGGGAACCCTGGTCACCGTCTCGAGC<br>(seq id no: 180) |
| ABT1-94 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCATGTGTATGATATGGGGTGGGTCCGCCAGGCTCCAG<br>GGAAGGGTCTAGAGTGGGTCTCATTTATTGATCGGATGGGTCGTCGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAACCTGGGTATCCGTTTG<br>ACTACTGGGGTCAGGGAACCCTGGTCACCGTCTCGAGC (seq id no: 181) |
| ABT1-96 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAATCAGTATAATATGTTTTGGGTCCGCCAGGCTCCAG<br>GGAAGGGTCTAGAGTGGGTCTCAGTTATTAGTGGTTCGGGTCGGTTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAGGGTGGTGGAGGCGTG<br>ATCCTCCTTTTGACTACTGGGGTCAGGGAACCCTGGTCACCGTCTCGAGC (seq id no:<br>182) |
| ABT1-97 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTGGGAGTATGATATGTATTGGGTCCGCCAGGCTCCAG<br>GGAAGGGTCTAGAGTGGGTCTCACGGATTTCTGGTTCGGGTCGTTATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTCGCTTACTCGTC<br>CGAGTCAGTTTGACTACTGGGGTCAGGGAACCCTGGTCACCGTCTCGAGC (seq id no:<br>183) |

TABLE 64-continued

DNA sequences for ABT1 and ABT2 dAbs

| dAb Name | DNA sequence |
| --- | --- |
| ABT1-98 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATGGTTATATTATGTCGTGGGTCCGCCAGGCTCCAG<br>GGAAGGGTCTAGAGTGGGTCTCAACTATTAGTCCGTTGGGTTCTGTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAGGGGCCGTGGTTTTG<br>ACTACTGGGGTCAGGGAACCCTGGTCACCGTCTCGAGC (seq id no: 184) |
| ABT1-99 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGTAAGTATTCTATGACGTGGGTCCGCCAGGCTCCAG<br>GGAAGGGTCTAGAGTGGGTCTCAGTTATTGATCCGTGGGGTCATTATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATCGGTTGATGCTACGC<br>TGTTGCGTAGGTATTTTGACTACTGGGGTCAGGGAACCCTGGTCACCGTCTCGAGC (seq<br>id no: 185) |
| ABT1-101 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCGAAGTATTGGATGAGTTGGGTCCGCCAGGCTCCAG<br>GGAAGGGTCTGGAGTGGGTCTCATCTATTTCTCCTGATGGTAAGACTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTGCGTTTGCGTTTG<br>ACTACTGGGGTCAGGGAACCCTGGTCACCGTCTCGAGC (SEQ ID NO: 186) |
| ABT1-102 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCGGAATTATGCGATGTCTTGGGTCCGCCAGGCTCCAG<br>GGAAGGGTCTAGAGTGGGTCTCAACGATTACTCCGCTGGGTTCTAGTACATACTATGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGGCGTGGGCTTTTG<br>ACTACTGGGGTCAGGGAA-CCTGGTCACCGTCTCGAGC (seq id no: 187) |
| ABT1-103 | GAGGTGCAGCTGTTGGAGTCTGGGGGAGGCTTGGTACGGCCTGGGGGGTCCCTGCGTCTCTC<br>CTGTGCAGCCTCCGGATTCACCTTTGAGCGGTATTGGATGACTTGGGTCCGCCAGGCTCCAG<br>GGAAGGGTCTAGAGTGGGTCTCATATATTTCGAGTAGTGGTACGGCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAGGGGCTCCGAATTTTG<br>ACTACTGGGGTCAGGGAACCCTGGTCACCGTCTCGAGC (seq id no: 188) |
| ABT1-104 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAAGTCTTATCCTATGCGTTGGGTCCGCCAGGCTCCAG<br>GGAAGGGTCTAGAGTGGGTCTCAACGATTAGTCCTTTGGGTTCTACGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGCTTCTTATTCTTTTG<br>ACTACTGGGGTCAGGGAACCCTGGTCACCGTCTCGAGC (seq id no: 189) |
| ABT1-105 | GAGGTGCAGCTGTTGGAGTCTGGGGGAGGCTTGGTACAGCCTGGGGGGTCCCTGCGTCTCTC<br>CTGTGCAGCCTCTGGATTCACCTTTTCGCAGTATCGTATGTTTTGGGCCGCCAGGCTCCAG<br>GGAAGGGTCTAGAGTGGGTCTCAACTATTAGTACTTCGGGTAATAAGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGTTTCTAAGCCGTTTG<br>ACTACTGGGGTCAGGGAACCCTGGTCACCGTCTCGAGC (seq id no: 190) |
| ABT1-106 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGAATTATACTATGAAGTGGGTCCGCCAGGCTCCAG<br>GGAAGGGTCTAGAGTGGGTCTCATCTATTTCGCCTGTTGGTTCGGTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAACCGTCGCCTTTTTTG<br>ACTACTGGGGTCAGGGAACCCTGGTCACCGTCTCGAGC (seq id no: 191) |
| ABT1-109 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGGGTATAATATGATGTGGGTCCGCCAGGCTCCAG<br>GGAAGGGTCTAGAGTGGGTCTCAACTATTGCGTATGATGGTTATCGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAATATGCAGATTACTA<br>GGCCGCGTCCGACGTTTGACTACTGGGGTCAGGGAACCCTGGTCACCGTCTCGAGC (seq<br>id no: 192) |
| ABT1-110 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGTCGGTATAATATGATGTGGGTCCGCCAGGCTCCAG<br>GGAAGGGTCTAGAGTGGGTCTCAACTATTTCGTATGATGGTTTTCGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAATCATTCTACTCAGG<br>GTAAGGCGAATGTGTCTGACTACTGGGGTCAGGGAACCCTGGTCACCGTCTCGAGC (seq<br>id no: 193) |

TABLE 64-continued

DNA sequences for ABT1 and ABT2 dAbs

| dAb Name | DNA sequence |
|---|---|
| ABT1-111 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTAATTATGGTATGCAGTGGGTCCGCCAGGCTCCAG<br>GGAAGGGTCTAGAGTGGGTCTCATATATTAGTGGTTCTGGTTTGCTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAATCTGATGTGGGTTTGC<br>GGCTGCCTGCTTCTTTTGACTACTGGGGTCAGGGAACCCTGGTCACCGTCTCGAGC (SEQ<br>ID NO: 194) |
| ABT1-113 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCAGAATTATGATATGACGTGGGTCCGCCAGGCTCCAG<br>GGAAGGGTCTAGAGTGGGTCTCAACGATTTCTAGTGGTGGTTCGTTGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACTTAGTTATCGTTGGT<br>CGTATACGTTTTCGGATTTTGACTACTGGGGTCAGGGAACCCTGGTCACCGTCTCGAGC<br>(SEQ ID NO: 195) |
| ABT1-117 | GAGGTGCAGCTGTTGGAGTCCGGGGGAGGCTTGGTACAGCCTGGGGGGTCCCTGCGTCTCTC<br>CTGTGCAGCCTCCGGATTCACCTTTGCGGGTATGATATGCTGTGGGTCCGCCAGGCTCCAG<br>GGAAGGGTCTAGAGTGGGTCTCAATGATTCTGGGGACTGGTAGTGGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACGG (SEQ ID NO:<br>196) |
| ABT1-118 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGCGTATACTATGTATTGGGTCCGCCAGGCTCCAG<br>GGAAGGGTCTAGAGTGGGTCTCACATATTTCGCCGGTGGGTTCTGATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATTTGTTTTTTGGCGG<br>GGCGTTTGCCTACTTTTGACTACTGGGGTCAGGGAACCCTGGTCACCGTCTCGAGC (SEQ<br>ID NO: 197) |
| ABT1-137 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGAGGTATTGGATGGCTTGGGTCCGCCAGGCTCCAG<br>GGAAGGGTCTAGAGTGGGTCTCAAATATTAATCTTACTGGTAGTGCGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAGGGGCTTTTCAGTTTG<br>ACTACTGGGGTCAGGGAACCCTGGTCACCGTCTCGAGC (SEQ ID NO: 198) |
| ABT1-138 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAATGAGTATCTTATGTATTGGGTCCGCCAGGCTCCAG<br>GGAAGGGTCTGGAGTGGGTCTCATCTATTAGTCCGCTTGGTTATCATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACGTGCTCGGTGGTATT<br>TTGACTACTGGGGTCAGGGAACCCTGGTCACCGTCTCGAGC (SEQ ID NO: 843) |
| ABT1-139 | GAGGTGCAGCTGTTGGAGTCTGGGGGAGGCTTGGTACAGCCTGGGGGGTCCCTGCGTCTCTC<br>CTGTGCAGCCTCCGGATTTACCTTTTCTGATTATACGATGATTTGGGTCCGCCAGGCTCCAG<br>GGAAGGGTCTGGAGTGGGTCTCATCTATTTCGGCTCGTGGTTGGGGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTAGTCCTCAGCTTG<br>TTCTGCCTTTTGACTACTGGGGTCAGGGAACCCTGGTCACCGTCTCGAGC (SEQ ID<br>NO: 199) |
| ABT1-140 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATGAGATGGATTGGGTCCGCCAGGCTCCAG<br>GGAAGGGTCTAGAGTGGGTCTCAACTATTTCTCCTCATGGTCTGCTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACGTTTGTGGCCTCAGA<br>GGAAGTGGACTTTTGACTACTGGGGTCAGGGAACCCTGGTCACCGTCTCGAGC (SEQ ID<br>NO: 200) |
| ABT1-147 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTACTTATAATATGATGTGGGTCCGCCAGGCTCCAG<br>GGAAGGGTCTAGAGTGGGTCTCAAGTATTACGCATGAGGGTACGATGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAATGGTCGTATTAGTC<br>AGAATCGGTTTGACTACTGGGGTCAGGGAACCCTGGTCACCGTCTCGAGC (SEQ ID<br>NO: 201) |
| ABT1 VK dAbs | |
| ABT1-3 | GACATCCAGATGACCCAGTCTCCATCCTCCCTGTCTGCATCTGTAGGAGACCGTGTCACCAT<br>CACTTGCCGGGCAAGTCAGAGCATTTGGACGGAGTTAAAGTGGTACCAGCAGAAACCAGGGA<br>AAGCCCCTAAGCTCCTGATCTATGGTGCATCCCTGTTGCAAAGTGGGGTCCCATCACGTTTC<br>AGTGGCAGTGGATCTGGGACAGATTTCACTCTCACCATCAGCAGTCTGCAACCTGAAGATTT |

TABLE 64-continued

DNA sequences for ABT1 and ABT2 dAbs

| dAb Name | DNA sequence |
|---|---|
| | TGCTACGTACTACTGTCAACAGTTTGCGTATTTTCCTTTTACGTTCGGCCAAGGGACCAAGG<br>TGGAAATCAAACGG (SEQ ID NO: 202) |
| ABT1-9 | GACATCCAGATGACCCAGTCTCCATCCTCCCTGTCTGCATCTGTAGGAGACCGTGTCACCAT<br>CACTTGCCGGGCAAGTCAGAGCATTGGTTCGTCGTTACTTTGGTACCAGCAGAAACCAGGGA<br>AAGCCCCTAAGCTCCTGATCTATTTGGCATCCCGTTTGCAAAGTGGGGTCCCATCACGTTTC<br>AGTGGCAGTGGATCTGGGACAGACTTCACTCTCACCATCAGCAGTCTGCAACCTGAAGATTT<br>TGCTACGTACTACTGTCAACAGTTTCGGTCTACGCCTAATACGTTCGGCCAAGGGACCAAGG<br>TGGAAATCAAACGG (SEQ ID NO: 203) |
| ABT1-9-<br>500 | GATATTCAGATGACCCAGAGCCCGAGCAGCCTGAGCGCGAGCGTGGGCGATCGTGTGACCAT<br>TACCTGCCGTGCGAGCCATCGTATTCAGGTGAGCCTGAACTGGTATCAGCGTAAACCGGGCA<br>AAGCGCCGAAACTGCTGGTGTATCTGGCGAGCCGTCTGCAGAGCGGCGTGCCGAGCCGTTTT<br>AGCGGCAGCGGCAGCGGCAGCGATTTTACCCTGACCATTAGCAGCCTGCAGCCGGGCGATTT<br>TGCGACCTATTATTGCCAGCAGTTTCGTAGCACCCCGAACACCTTTGGCCAGGGCACCAAAG<br>TGGAAATTCGTCGT (SEQ ID NO: 204) |
| ABT1-10 | GACATCCAGATGACCCAGTCTCCATCCTCCCTGTCTGCATCTGTAGGAGACCGTGTCACCAT<br>CACTTGCCGGGCAAGTCAGAGCATTGTGCCGAATTTAAGGTGGTACCAGCAGAAACCAGGGA<br>AAGCCCCTAAGCTCCTGATCTATGGTGCATCCACGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGTTATGTTTATCCTGGGACGTTCGGCCAAGGGACCAAGG<br>TGGAAATCAAACGG (SEQ ID NO: 205) |
| ABT1-11 | GACATCCAGATGACCCAGTCTCCATCCTCCCTGTCTGCATCTGTAGGAGACCGTGTCACCAT<br>CACTTGCCGGGCAAGTCAGAGCATTCCGTATAATTTACGTTGGTACCAGCAGAAACCAGGGA<br>AAGCCCCTAAGCTCCTGATCTATAGTGCATCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGTATAGTTGGCCTATGACGTTCGGCCAAGGGACCAAGG<br>TGGAAATCAAACGG (SEQ ID NO: 206) |
| ABT1-12 | GACATCCAGATGACCCAGTCTCCATCCTCCCTGTCTGCATCTGTAGGAGACCGTGTCACCAT<br>CACTTGCCGGGCAAGTCAGAGCATTTGGACGGAGTTAAAGTGGTACCAGCAGAAACCAGGGA<br>AAGCCCCTAAGCTCCTGATCTATGGTGCATCCCTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCGTATTTTCCTTTTACGTTCGGCCAAGGGACCAAGG<br>TGGAAATCAAACGG (SEQ ID NO: 207) |
| ABT1-13 | GACATCCAGATGACCCAGTCTCCATCCTCCCTGTCTGCATCTGTAGGAGACCGTGTCACCAT<br>CACTTGCCGGGCAAGTCAGAGCATTCGTACTTTTTTAAATTGGTACCAGCAGAAACCAGGGA<br>AAGCCCCTAAGCTCCTGATCTATTGGGCATCCCCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACTAGTCGGGCTCCTTATACGTTCGGCCAAGGGACCAAGG<br>TGGAAATCAAACGG (seq id no: 208) |
| ABT1-14 | GACATCCAGATGACCCAGTCTCCATCCTCCCTGTCTGCATCTGTAGGAGACCGTGTCACCAT<br>CACTTGCCGGGCAAGTCAGAGCATTTGGACGGAGTTAAAGTGGTACCAGCAGAAACCAGGGA<br>AAGCCCCTAAGCTCCTGATCTATGGTGCATCCCTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCGTATTTTCCTTTTACGTTCGGCCAAGGGACCAAGG<br>TGGAAATCAAACGG (SEQ ID NO: 209) |
| ABT1-18 | GACATCCAGATGACCCAGTCTCCATCCTCCCTGTCTGCATCTGTAGGAGACCGTGTCACCAT<br>CACTTGCCGGGCAAGTCAGAGCATTCAGCGTTGGTTAGCTTGGTACCAGCAGAAACCAGGGA<br>AAGCCCCTAAGCTCCTGATCTATTTTGCATCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTGCTGAGGTTGCCTAAGACGTTCGGCCAAGGGACCAAGG<br>TGGAAATCAAACGG (SEQ ID NO: 210) |
| ABT1-24 | GACATCCAGATGACCCAGTCTCCATCCTCCCTGTCTGCATCTGTAGGAGACCGTGTCACCAT<br>CACTTGCCGGGCAAGTCAGAGCATTAGGGCTAAGTTACGTTGGTACCAGCAGAAACCAGGGA<br>AAGCCCCTAAGCTCCTGATCTATAGGGCATCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGGGCTCGGCATCCTCATACGTTCGGCGAAGGGACCAAGG<br>TGGAAATCAAACGG (SEQ ID NO: 211) |
| ABT1-25 | GACATCCAGATGACCCAGTCTCCATCCTCCCTGTCTGCATCTGTAGGAGACCGTGCCACCAT<br>CACTTGCCGGGCAAGTCAGAGCATTAGGGCTAAGTTACGTTGGTACCAGCAGAAACCAGGGA<br>AAGCCCCTAAGCTCCTGATCTATAGGGCATCCCAGTTGCAAAGTGGGGTCCCATCACGTTTC<br>AGTGGCAGTGGATCTGGGACAGATTTCACTCTCACCATGAGCAGTCTGCAACCTGAAGATTT<br>TGCTACGTACTACTGTCAACAGAGGGCTCGGCATCCTCATACGTTCGGCCAAGGGACCAAGG<br>TGGAAATCAAACGG (SEQ ID NO: 212) |
| ABT1-26 | GACATCCAGATGACCCAGTCTCCATCCTCCCTGTCTGCATCCGTAGGAGACCGTGTCACCAT<br>CACTTGCCGGGCAAGTCAGAGCATTGGTAATGTTTTACGGTGGTACCAGCAGAAACCAGGGA<br>AAGCCCCTAAGCTCCTGATCTATCGTGCAGCCATGTTGCAAAGTGGGGTCCCATCACGTTTC |

TABLE 64-continued

DNA sequences for ABT1 and ABT2 dAbs

| dAb Name | DNA sequence |
|---|---|
| | AGTGGCAGTGGATCTGGGACAGATTTCACTCTCACCATCAGCAGTCTGCAACCTGAAGATTT<br>TGCTACGTACTACTGTCAACAGAGGCGGACTTATCCTTGGACGTTCGGCCAAGGGACCAAGG<br>TGGAAATCAAACGG (SEQ ID NO: 213) |
| ABT1-27 | GACATCCAGATGACCCAGTCTCCATCCTCCCTGTCTGCATCTGTAGGAGACCGTGTCACCAT<br>CACTTGCCGGGCAAGTCAGAGCATTAAGCAGAAGTTAAAGTGGTACCAGCAGAAACCAGGGA<br>AAGCCCCTAAGCTCCTGATCTATTGGGCATCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGCATCTGAAGCCTTATACGTTCGGCCAAGGGACCAAGG<br>TGGAAATCAAACGG (SEQ ID NO: 214) |
| ABT1-28 | GACATCCAGATGACCCAGTCTCCATCCTCCCTGTCTGCATCTGTAGGAGACCGTGTCACCAT<br>CACTTGCCGGGCAAGTCAGAGCATTAAGAATCGGTTACGTTGGTACCAGCAGAAACCAGGGA<br>AAGCCCCTAAGCTCCTGATCTATCGTGCATCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGTATCATATTCCTAGGACGTTCGGCCAAGGGACCAAGG<br>TGGAAATCAAACGG (SEQ ID NO: 215) |
| ABT1-29 | GACATCCAGATGACCCAGTCTCCATCCTCCCTGTCTGCATCTGTAGGAGACCGTGTCACCAT<br>CACTTGCCGGGCAAGTCAGAGCATTCGTTCTCGTTTATCGTGGTACCAGCAGAAACCAGGGA<br>AAGCCCCTAAGCTCCTGATCTATAGGGCATCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGTTTTATTTGGCCTAGGACGTTCGGCCAAGGGACCAAGG<br>TGGAAATCAAACGG (SEQ ID NO: 216) |
| ABT1-30 | GACATCCAGATGACCCAGTCTCCATCCTCCCTGTCTGCATCTGTAGGAGACCGTGTCACCAT<br>CACTTGCCGGGCAAGTCAGAGCATTAATAGGGGTTTAAGGTGGTACCAGCAGAAACCAGGGA<br>AAGCCCCTAAGCTCCTGATCTATCGTGCATCCGTTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGTGAGTCGTCGTCCTCGGACGTTCGGCCAAGGGACCAAGG<br>TGGAAATCAAACGG (SEQ ID NO: 217) |
| ABT1-53 | GACATCCAGATGACCCAGTCTCCATCCACCCTGTCTGCATCTGTAGGAGACCGTGTCACCAT<br>CACTTGCCGGGCAAGTCAGAGCATTAGGGCTAAGTTACGTTGGTACCAGCAGAAACCAGGGA<br>AGGCCCCTAAGCTCCTGATCTATAAGGCATCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGTGGGCTTCTTCCTTTTACGTTCGGCCAAGGGACCAAGG<br>TAGAAATCAAACGG (SEQ ID NO: 218) |
| ABT1-54 | GACATCCAGATGACCCAGTCTCCATCCTCCCTGTCTGCATCTGTAGGAGACCGTGTCACCAT<br>CACTTGCCGGGCAAGTCAGAGCATTGGTAGGAAGTTACGGTGGTACCAGCAGAAACCAGGGA<br>AAGCCCCTAAGCTCCTGATCTATCATGCATCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGGGTTCGTATGCCTTTTACGTTCGGCCAAGGGACCAAGG<br>TGGAAATCAAACGG (SEQ ID NO: 219) |
| ABT1-56 | GACATCCAGATGACCCAGTCTCCATCCTCCCTGTCTGCATCTGTAGGAGACCGTGTCACCAT<br>CACTTGCCGGGCAAGTCAGAGCATTAAGACTCGTTTACAGTGGTACCAGCAGAAACGAGGGA<br>AAGCCCCTAAGCTCCTGATCTATCATGCATCCGTGTTGCAAAGTGGGGTCCCATCACGTTTC<br>AGTGGCAGTGGATCTGGGACAGATTTCACTCTCACCATCAGCAGTCTACAACCTGAAGATTT<br>TGCTACGTACTACTGTCAACAGCGGAAGATGCGTCCTCATACGTTCGGCCAAGGGACCAAGG<br>TGGAAATCAAACGG (SEQ ID NO: 220) |
| ABT1-57 | GACATCCAGATGACCCAGTCTCCATCCTCCCTGTCTGCATCTGTAGGAGACCGTGTCACCAT<br>CACTTGCCGGGCAAGTCAGAGCATTAAGCGTGAGTTAGCGTGGTACCAGCAGAAACCAGGGA<br>AAGCCCCTAAGCTCCTGATCTATAAGGCATCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGGAAGTCGCATCCTCGGACGTTCGGCCAAGGGACCAAGG<br>TGGAAATCAAACGG (SEQ ID NO: 221) |
| ABT1-59 | GACATCCAGATGACCCAGTCTCCATCCTCCCTGTCTGCATCTGTAGGAGACCGTGTCACCAT<br>CACTTGCCGGGCAAGTCAGAGCATTGGGCGGCGTTTAGCTTGGTACCAGCAGAAACCAGGGA<br>AAGCCCCTAAGCTCCTGATCTATTGGGCATCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGAATGTGTGGCCTTATACGTTCGGCCAAGGGACCAAGG<br>TGGAAATCAAACGG (seq id no: 222) |
| ABT1-60 | GACATCCAGATGACCCAGTCTCCATCCTCCCTGTCTGCATCTGTAGGAGACCGTGTCACCAT<br>CACTTGCCGGGCAAGTCAGAGCATTGGTCGTCGTTTAAAGTGGTACCAGCAGAAACCAGGGA<br>AAGCCCCTAAGCTCCTGATCTATAAGGCATCCAGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAATAGTCATCATCCTTATACGTTCGGCCAAGGGACCAAGG<br>TGGAAATCAAACGG (SEQ ID NO: 223) |
| ABT1-61 | GACATCCAGATGACCCAGTCTCCATCCTCCCTGTCTGCATCTGTAGGAGACCGTGTCACCAT<br>CACTTGCCGGGCAAGTCAGAGCATTGGGCATCGTTTAAGGTGGTACCAGCAGAAACCAGGGA |

TABLE 64-continued

DNA sequences for ABT1 and ABT2 dAbs

| dAb Name | DNA sequence |
|---|---|
|  | AAGCCCCTAAGCTCCTGATCTATAAGGCATCCCTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGTGCGTGCGTATCCTCGTACGTTCGGCCAAGGGACCAAGG<br>TGGAAATCAAACGG (SEQ ID NO: 224) |
| ABT1-62 | GACATCCAGATGACCCAGTCTCCATCCCCCTGTCTGCATCTGTAGGAGACCGTGTCACCAT<br>CACTTGCCGGGCAAGTCAGAGCATTCCGTTTTATTTAGGGTGGTACCAGCAGAAACCAGGGA<br>AAGCCCCTAAGCTCCTGATCTATAGGGCATCCATGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGATTCTTCAGGCTCCTCCGACGTTCGGCCAAGGGACCAAGG<br>TGGAAATCAAACGG (seq id no: 225) |
| ABT1-63 | GACATCCAGATGACCCAGTCTCCATCCTCCCTGTCTGCATCTGTAGGAGACCGTGTCACCAT<br>CACTTGCCGGGCAAGTCAGAGCATTGGTGCGTTTTTAGGTTGGTACCAGCAGAAACCAGGGA<br>AAGCCCCTAAGCTCCTGATCTATCGGGCATCCCCTTTGCAAAGTGGGGTCCCATCACGTTTC<br>AGTGGCGGTGGATCTGGGACAGATTTCACTCTCACCATCAGCAGTCTGCAACCTGAAGATTT<br>TGCTACGTACTACTGTCAACAGCAGCGTGTGGTTCCTGGGACGTTCGGCCAAGGGACCAAGG<br>TGGAAATCAAACGG (seq id no: 226) |
| ABT1-64 | GACATCCAGATGACCCAGTCTCCATCCTCCCTGTCTGCATCTGTAGGAGACCGTGTCACCAT<br>CACTTGCCGGGCAAGTCAGAGCATTTCGAAGGTGTTAGGTTGGTACCAGCAGAAACCAGGGA<br>AAGCCCCTAAGCTCCTGATCTATAAGGCATCCATTTTGCAAAGTGGGGTCCCATCACGTCTC<br>AGTGGCAGTGGATCTGGGACAGATTTCACTCTCACCATCAGCAGTCTGCAACCTGAAGATTT<br>TGCTACGTACTACTGTCAACAGGCGCTTGATTTTCCTTATACGTTCGGCCAAGGGACCAAGG<br>TGGAAATCAAACGG (SEQ ID NO: 227) |
| ABT1-65 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCTATGCTGCATCCAGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGATTATGATTTTCCTATTACGTTCGGCCAAGGGACCAAGG<br>TGGAAATCAAACGG (SEQ ID NO: 228) |
| ABT1-66 | GACATCCAGATGACCCAGTCTCCATCCTCCCTGTCTGCATCTGTAGGAGACCGTGTCACCAT<br>CACTTGCCGGGCAAGTCAGAGCATTATGCGGAAGTTAAGGTGGTACCAGCAGAAACCAGGGA<br>AAGCCCCTAAGCTCCTGATCTATAAGGCATCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGTCATCGGAGGCCTTATACGTTCGGCCAAGGGACCAAGG<br>TGGAAATCAAACGG (SEQ ID NO: 229) |
| ABT1-67 | GACATCCAGATGACCCAGTCTCCATCCTCCCTGTCTGCATCTGTAGGAGACCGTGTCACCAT<br>CACTTGCCGGGCAAGTCAGAGCATTCATCGTTCTTTACGTTGGTACCAGCAGAAACCAGGGA<br>AAGCCCCTAAGCTCCTGATCTATCATGCATCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTATAAGCGGCGTCCTTCTACGTTCGGCCAAGGGACCAAGG<br>TGGAAATCAAACGG (SEQ ID NO: 230) |
| ABT1-68 | GACATCCAGATGACCCAGTCTCCATCCTCCCTGTCTGCATCTGTAGGAGACCGTGTCACCAT<br>CACTTGCCGGGCAAGTCAGAGCATTCATAAGCAGTTAACGTGGTACCAGCAGAAACCAGGGA<br>AAGCCCCTAAGCTCCTGATCTATAGGGCATCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTATCATCATAGGCCTTCAACGTTCGGCCAAGGGACCAAGG<br>TGGAAATCAAACGG (SEQ ID NO: 231) |
| ABT1-82 | GACATCCAGATGACCCAGTCTCCATCCTCCCTGTCTGCATCTGTAGGAGACCGTGTCACCAT<br>CACTTGCCGGGCAAGTCAGAGCATTGGGAAGTCGTTACGGTGGTACCAGCAGAAACCAGGGA<br>AAGCCCCTAAGCTCCTGATCTATCGTGCATCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGTTATGTTTGGGCCTCGTACGTTCGGCCAAGGGACCAAGG<br>TGGAAATCAAACGG (SEQ ID NO: 232) |
| ABT1-95 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATAATATTTCCAATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGTATCGTTGGCCTGTTACGTTCGGCCAAGGGACCAAGG<br>TGGAAATCAAACGG (SEQ ID NO: 233) |
| ABT1-95-3 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 234) |

TABLE 64-continued

DNA sequences for ABT1 and ABT2 dAbs

| dAb Name | DNA sequence |
| --- | --- |
| ABT1-95-4 | GACATCCAGATGACCCAGTCTCCATCCTCCCTGTCTGCATCTGTAGGAGACCGTGTCACCAT<br>CACTTGCCGGGCAAGTCAGCCGATTGTGCGCAACTTAAGGTGGTATCAGCAGAAACCAGGGA<br>AAGCCCCTAAGCTCCTGATCTATTCTTCGTCCTATTTGCAAAGTGGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 235) |
| ABT1-95-6 | GACATCCAGATGACCCAGTCACCATCCTCTCTGTCTGCATCTGTAGGAGACCGTGTCACCAT<br>CACTTGCCGGGCAAGTCAGCCGATTCAGGGGAATTTACGTTGGTATCAGCAGAAACCAGGGA<br>AGGCCCCTAAGCTCCTGATCTATTCTTCGTCCTATTTGGAAAGTGGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 236) |
| ABT1-95-8 | GACATCCAGATGACCCAGTCACCATCCTCTCTGTCTGCATCTGTAGGAGACCGTGTCACCAT<br>CACTTGCCGGGCAAGTCAGCCGATTCAGGGGAATTTACGTTGGTATCAGCAGAAACCAGGGA<br>AAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 237) |
| ABT1-95-9 | GACATCCAGATGACCCAGTCACCATCCTCTCTGTCTGCATCTGTAGGAGACCGTGTCACCAT<br>CACTTGCCGGGCAAGTCAGCCGATTCAGGGGAATTTACGTTGGTATCAGCAGAAACCAGGGA<br>AAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCATCCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 238) |
| ABT1-95-10 | GACATCCAGATGACCCAGTCACCATCCTCTCTGTCTGCATCTGTAGGAGACCGTGTCACCAT<br>CACTTGCCGGGCAAGTCAGCCGATTCAGGGGAATTTACGTTGGTATCAGCAGAAACCAGGGA<br>AAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCATCCTGAAGATCT<br>TGCTACGTACCACTGTCAACAGGGGTATCGTTGGCCTGTTACGTTCGGCCAAGGGACCAAGG<br>TGGAAATCAAACGG (SEQ ID NO: 239) |
| ABT1-95-11 | GACATCCAGATGACCCAGTCACCATCCTCTCTGTCTGCATCTGTAGGAGACCGTGTCACCAT<br>CACTTGCCGGGCAAGTCAGCCGATTCAGGGGAATTTACGTTGGTATCAGCAGAAACCAGGGA<br>TAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCATCCTGAAGATCT<br>TGCTACGTACCACTGTCAACAGGGGTATCGTTGGCCTGTTACGTTCGGCCAAGGGACCAAGG<br>TGGAAATCAAACGG (SEQ ID NO: 240) |
| ABT1-95-12 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATTCTTCGTCCTATTTGGAAAGTTGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 241) |
| ABT1-95-13 | GACATCCAGATGACCCAGTCTCCATCCTCCCTGTCTGCATCTGTAGGAGACCGTGTCACCAT<br>CACTTGCCGGGCAAGTCAGCCGATTGTGCGCAACTTAAGGTGGTATCAGCAGAAACCAGGGA<br>AAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 242) |
| ABT1-95-14 | GACATCCAGATGACCCAGTCTCCATCCTCCCTGTCTGCATCTGTAGGAGACCGTGTCACCAT<br>CACTTGCCGGGCAAGTCAGCCGATTGTGAAGAACTTAAGGTGGTATCAGCAGAAACCAGGGA<br>AAGCCCCTAAGCTCCTGATCTATTCTTCGTCCTATTTGGAAAGAGGGGTCCCATCACGTTTC<br>AGTGGTAGTGGATCCGGGACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 243) |
| ABT1-95-15 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 244) |
| ABT1-95-21 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC |

TABLE 64-continued

DNA sequences for ABT1 and ABT2 dAbs

| dAb Name | DNA sequence |
|---|---|
| | AGTGGTAGTGGATCCGGGACAGATTTCACTCTCACCATCAGCAGTCTGCAACCCGAAGATTT<br>TGCTACGTACTACTGTCAACAGGGGTATCGTTGGCCTGTTACGTTCGGCCAAGGGACCAAGG<br>TGGAAATCAAACGG (SEQ ID NO: 245) |
| ABT1-95-22 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTATCACTGGCCTGTTACGTTCGGCCAAGGGACCAAGG<br>TGGAAATCAAACGG (SEQ ID NO: 246) |
| ABT1-95-23 | GACATCCAGATGACCCAGTCTCCATCCTCCCTGTCTGCATCTGTAGGAGACCGTGTCACCAT<br>CACTTGCCGGGCAAGTCAGCCGACTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTACCGTTGGCCTGTTACGTTCGGCCAAGGGACCAAGG<br>TGGAAATCAAACGG (SEQ ID NO: 247) |
| ABT1-95-24 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTTGCCAGGGGTATCGTTGGCCTGTTACGTTCGGCCAAGGGACCAAGG<br>TGGAAATCAAACGG (SEQ ID NO: 248) |
| ABT1-95-25 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTGACCAGGGGTATCGTTGGCCTGTTACGTTCGGCCAAGGGACCAAGG<br>TGGAAATCAAACGG (SEQ ID NO: 249) |
| ABT1-95-26 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTGGCCAGGGGTATCGTTGGCCTGTTACGTTCGGCCAAGGGACCAAGG<br>TGGAAATCAAACGG (SEQ ID NO: 250) |
| ABT1-95-27 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTGCGCAGGGGTATCGTTGGCCTGTTACGTTCGGCCAAGGGACCAAGG<br>TGGAAATCAAACGG (SEQ ID NO: 251) |
| ABT1-95-28 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTATGGCTGGCCTGTTACGTTCGGCCAAGGGACCAAGG<br>TGGAAATCAAACGG (SEQ ID NO: 252) |
| ABT1-95-29 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTATCAGTGGCCTGTTACGTTCGGCCAAGGGACCAAGG<br>TGGAAATCAAACGG (SEQ ID NO: 253) |
| ABT1-95-30 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGTCCTATCGTTGGCCTGTTACGTTCGGCCAAGGGACCAAGG<br>TGGAAATCAAACGG (SEQ ID NO: 254) |
| ABT1-95-31 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTATCTGTGGCCTGTTACGTTCGGCCAAGGGACCAAGG<br>TGGAAATCAAACGG (SEQ ID NO: 255) |

TABLE 64-continued

DNA sequences for ABT1 and ABT2 dAbs

| dAb Name | DNA sequence |
| --- | --- |
| ABT1-95-32 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCAACAGGGGTATTCCTGGCCTGTTACGTTCGGCCAAGGGACCAAGG<br>TGGAAATCAAACGG (SEQ ID NO: 256) |
| ABT1-95-33 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACTACTGTCGCCAGGGGTATCGTTGGCCTGTTACGTTCGGCCAAGGGACCAAGG<br>TGGAAATCAAACGG (SEQ ID NO: 257) |
| ABT1-95-34 | GACATCCAGATGACCCAGTCTCCATCCTCCCTGTCTGCATCTGTAGGAGACCGTGTCACCAT<br>CACTTGCCGGGCAAGTCGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 258) |
| ABT1-95-35 | GACATCCAGATGACCCAGTCTCCATCCTCCCTGTCTGCATCTGTAGGAGACCGTGTCACCAT<br>CACTTGCCGGGCAAGTGGGCCGATTGTGCGGAACTTAAGGTGGTATCAGCAGAAACCAGGAA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 259) |
| ABT1-95-36 | GACATCCAGATGACCCAGTCTCCATCCTCCCTGTCTGCATCTGTAGGAGACCGTGTCGCCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 260) |
| ABT1-95-37 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 261) |
| ABT1-95-38 | GACATCCAGATGACCCAGTCTCCATCCTCCCTGCCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCCAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 262) |
| ABT1-95-39 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCGGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 263) |
| ABT1-95-40 | GACATCCAGATGACCCAGTCTCCATCCTCCCTGTCTGCATCTGTAGGAGACCGTGTCACCAT<br>CACTTGCCGGGCAAGTCCCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 264) |
| ABT1-95-41 | GACATCCAGATGACCCAGTCTCCATCCTCCCTGTCTGCATCTGTAGGAGACCGTGTCACCAT<br>CACTTGCCGGGCAAGTTACCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 265) |
| ABT1-95-42 | GACATCCAGATGACCCAGTCTCCATCCTCCCTGTCTGCATCTGTAGGAGACCGTGTCACCAT<br>CACTTGCCGGGCAAGTTTCCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC |

TABLE 64-continued

DNA sequences for ABT1 and ABT2 dAbs

| dAb Name | DNA sequence |
|---|---|
| | AGTGGTAGTGGATCCGGGACAGATTTCACTCTCACCATCAGCAGTCTGCAACCCGAAGATTT<br>TGCCACGTACCACTGTCAACAGGGGTATCGTTGGCCTGTTACGTTCGGCCAAGGGACCAAGG<br>TGGAAATCAAACGG (SEQ ID NO: 266) |
| ABT1-95-<br>43 | GACATCCAGATGACCCAGTCTCCATCCTCCCTGTCTGCATCTGTAGGAGACCGTGTCACCAT<br>CACTTGCCGGGCAAGTCTCCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 267) |
| ABT1-95-<br>44 | GACATCCAGATGACCCAGTCTCCATCCTCCCTGTCTGCATCTGTAGGAGACCGTGTCACCAT<br>TACTTGCCGGGCAAGTTCCCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 268) |
| ABT1-95-<br>45 | GACATCCAGATGACCCAGTCTCCATCCTCCCTGTCTGCATCTGTAGGAGACCGTGTCACCAT<br>CACTTGCCGGGCAAGTCCCCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAAATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 269) |
| ABT1-95-<br>46 | GACATCCAGATGACCCAGTCTCCATCCTCCCTGTCTGCATCTGTAGGAGACCGTGTCACCAT<br>CACTTGCCGGGCAAGTTCGCCGATTGTGCAGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 270) |
| ABT1-95-<br>47 | GACATCCAGATGACCCAGTCTCCATCCTCCCTGTCTGCATCTGTAGGAGACCGTGTCACCAT<br>CACTTGCCGGGCAAGTATGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 271) |
| ABT1-95-<br>48 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 272) |
| ABT1-95-<br>49 | GACATCCAGATGACCCAGTCTCCATCCTCCCTATCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 273) |
| ABT1-95-<br>50 | GACATCCAGATGACCCAGTCTCCATCCTCCCTGTCTGCATCTGTAGGAGACCGTGTCACCAT<br>CACTTGCCGGGCAAGTCAGCCGATTCCGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 274) |
| ABT1-95-<br>51 | GACATCCAGATGACCCAGTCTCCATCCTCCCTGTCTGCATCTGTAGGAGACCGTGTCACCAT<br>CACTTGCCGGGCAAGTCAGCCGATTATCCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 275) |
| ABT1-95-<br>52 | GACATCCAGATGACCCAGTCTCCATCCTCCCTGTCTGCATCTGTAGGAGACCGTGTCACCAT<br>CACTTGCCGGGCAAGTCAGCCGATTGTGTCGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 276) |
| ABT1-95-<br>53 | GACATCCAGATGACCCAGTCTCCATCCTCCCTGTCTGCATCTGTAGGAGACCGTGTCACCAT<br>CACTTGCCGGGCAAGTCAGCCGATTGTGGCCAACTTAAGGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 277) |
| ABT1-95-54 | GACATCCAGATGACCCAGTCTCCATCCTCCCTGTCTGCATCTGTAGGAGACCGTGTCACCAT<br>CACTTGCCGGGCAAGTCAGCCGATTGTGACCAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 278) |
| ABT1-95-55 | GACATCCAGATGACCCAGTCTCCATCCTCCCTGTCTGCATCTGTAGGAGACCGTGTCACCAT<br>CACTTGCCGGGCAAGTCAGCCGATTGTGCACAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 279) |
| ABT1-95-56 | GACATCCAGATGACCCAGTCTCCATCCTCCCTGTCTGCATCTGTAGGAGACCGTGTCACCAT<br>CACTTGCCGGGCAAGTCAGCCGATTGTGCGCAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 280) |
| ABT1-95-57 | GACATCCAGATGACCCAGTCTCCATCCTCCCTGTCTGCATCTGTAGGAGACCGTGTCACCAT<br>CACTTGCCGGGCAAGTCAGCCGATTGTGGAGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 281) |
| ABT1-95-58 | GACATCCAGATGACCCAGTCTCCATCCTCCCTGTCTGCATCTGTAGGAGACCGTGTCACCAT<br>CACTTGCCGGGCACGTCAGCCGATTGTGTCGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 282) |
| ABT1-95-59 | GACATCCAGATGACCCAGTCTCCATCCTCCCTGTCTGCATCTGTAGGAGACCGTGTCACCAT<br>CACTTGCCGGGCAAGTCAGCCGATTGTGAAGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 283) |
| ABT1-95-60 | GACATCCAGATGACCCAGTCTCCAGCCTCCCTGTCTGCATCTGTAGGAGACCGTGTCACCAT<br>CACTTGCCGGGCAAGTCAGCCGATTGTGGCCAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 284) |
| ABT1-95-61 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTACGCTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 285) |
| ABT1-95-62 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTACTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 286) |
| ABT1-95-63 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACTAGGGA<br>AAGCCCCTAAGCTCCTGATCTTCTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 287) |

TABLE 64-continued

DNA sequences for ABT1 and ABT2 dAbs

| dAb Name | DNA sequence |
|---|---|
| ABT1-95-64 | GACATCCAGATGACCCAGTCCCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGGTCCACTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAGTCAAACGG (SEQ ID NO: 288) |
| ABT1-95-65 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATGGCTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 289) |
| ABT1-95-66 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGGTCTATTTCTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 290) |
| ABT1-95-67 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATGCGTCGTCCTATTTGGAGCCCGGGGTCCCATCACGTTTC<br>AGTGGTAGTGGATCCGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 291) |
| ABT1-95-68 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCGTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 292) |
| ABT1-95-69 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATAAGTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 293) |
| ABT1-95-70 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGGTCTATGGCTCGTCCTATTTGGAGCCCGGGGTCCCATCACGTTTC<br>AGTGGTAGTGGATCTGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 294) |
| ABT1-95-71 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATAACTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 295) |
| ABT1-95-72 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATCACTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 296) |
| ABT1-95-73 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATCAGTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 297) |
| ABT1-95-74 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAGACCAGGGA<br>AAGCCCCTAAGCTCCTGATCTATTCGGGTCCTATTTGGAGCCCGGGGTCCCATCACGTTTC |

TABLE 64-continued

DNA sequences for ABT1 and ABT2 dAbs

| dAb Name | DNA sequence |
| --- | --- |
|  | AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 298) |
| ABT1-95-<br>75 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTGCCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 299) |
| ABT1-95-<br>76 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTGGCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 300) |
| ABT1-95-<br>77 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTGAGCTCCTGATCTATTCTGGCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 301) |
| ABT1-95-<br>78 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTGAGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 302) |
| ABT1-95-<br>79 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTAGCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 303) |
| ABT1-95-<br>80 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 304) |
| ABT1-95-<br>81 | GACATCCAGATGACCCAGTCTCCATCCTTCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTAGCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 305) |
| ABT1-95-<br>82 | GACATCCCGATGACCCAGTCTCCATCCTCCCTGTCTGCATCTGTAGGAGACCGTGTCACTAT<br>CACTTGCCGGGCAAGTCAGCCGATTGTGCGGAACTTAAGGTGGTATCAGCAGAAACCAGGGA<br>AAGCCCCTAAGCTCCTGATCTATTCTACCTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 306) |
| ABT1-95-<br>83 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCACCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 307) |
| ABT1-95-<br>84 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTGGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 308) |
| ABT1-95-<br>85 | GACATCCAGATGACCCAGTCTCCATCCTCCCTGTCTGCATCTGTAGGAGACCGTGTCACCAT<br>CACTTGCCGGGCAGGTCAGCCGATTGTGCGGAACTTAAGGTGGTATCAGCAGAAACCAGGGA |

TABLE 64-continued

DNA sequences for ABT1 and ABT2 dAbs

| dAb Name | DNA sequence |
| --- | --- |
| | AAGCCCCTAAGCTCCTGATCTATTCTGGGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTACAGGGGTATCGTTGGCCTGTTACGTTCGGCCAAGGGACCAAGG<br>TGGAAATCAAACGG (SEQ ID NO: 309) |
| ABT1-95-86 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTACGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 310) |
| ABT1-95-87 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCCGGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 311) |
| ABT1-95-88 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTACTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG(SEQ ID NO: 312) |
| ABT1-95-89 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCCTCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 313) |
| ABT1-95-90 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCCAGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 314) |
| ABT1-95-91 | GACATCCAGATGACCCAGTCTCCATCCTCCCTGTCTGCATCTGTAGGAGACCGTGTCACCAT<br>CACTTGCCGGGCGAGTCAGCCGATTGTGCGGAACTTAAGGTGGTATCAGCAGAAACCAGGGA<br>AAGCCCCTAAGCTCCTGATCTATTCTTCGTCCAATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 315) |
| ABT1-95-92 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCACCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 316) |
| ABT1-95-93 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCATCTTGGAGCCCGGGGTCCCATCACGTTTC<br>AGTGGTGGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 317) |
| ABT1-95-94 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTCCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 318) |
| ABT1-95-95 | GACATCCAGATGATCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCCAGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 319) |

TABLE 64-continued

DNA sequences for ABT1 and ABT2 dAbs

| dAb Name | DNA sequence |
| --- | --- |
| ABT1-95-96 | GACATCCAGATGACCCAGTCTCCATCCTCCCTGTCTGCATCTGTAGGAGACCGTGTCACCAT<br>CGCTTGCCGGGCAAGTCAGCCGATTGTGCGGAACTTAAGGTGGTATCAGCAGAAACCAGGGA<br>AAGCCCCTAAGCTCCTGATCTATTCTTCGTCCAGGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 320) |
| ABT1-95-97 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTTCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 321) |
| ABT1-95-98 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCGCGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 322) |
| ABT1-95-99 | GACATCCAGATGACCCAGTCTCCATCCTCCCTGTCTGCATCTGTAGGAGACCGTGTCTCCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCACGTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 323) |
| ABT1-95-100 | GACATCCAGATGACCCAGTCTCCATCCTCCCTGTCTGCATCTGTAGGAGACCGTGTCACCAT<br>CACTTGCCGGGCAAGTCGCCGATTGTGCGGAACTTAAGGTGGTATCAGCAGAAACCAGGGA<br>AAGCCCCTAAGCTCCTGATCTATTCTTCGTCCCTCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 324) |
| ABT1-95-101 | GACATCCAGATGACCCAGTCTCCATCCTCCCTGTCTGCATCCGTAGGAGACCGTGTCACCAT<br>CACTTGCCGGGCGAGTCAGCCGATTGTGCGGAACTTAAGGTGGTATCAGCAGAAACCAGGGA<br>AAGCCCCTAAGCTCCTGGTCTATTCTTCGTCCCTCTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 325) |
| ABT1-95-102 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGCAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 326) |
| ABT1-95-103 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGAAGGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 327) |
| ABT1-95-104 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGTCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 328) |
| ABT1-95-105 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCGCGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 329) |
| ABT1-95-106 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGAGGGGGGTCCCATCACGTTTC |

TABLE 64-continued

DNA sequences for ABT1 and ABT2 dAbs

| dAb Name | DNA sequence |
|---|---|
| | AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTGCGTTCGGCCAAGGGACCAAGG<br>TGGAAATCAAACGG (SEQ ID NO: 330) |
| ABT1-95-<br>107 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCACGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG(SEQ ID NO: 331) |
| ABT1-95-<br>108 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGGAGGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 332) |
| ABT1-95-<br>109 | GACATCCAGATGACCCAGTCTCCATCCTCCCTGTCTGCATCTGTAGGAGACCGTGTCACCAT<br>CACTTGCCGGGCAAATCAGCCGATTGTGCGGAACTTAAGGTGGTATCAGCAGAAACCAGGGA<br>AAGCCCCTAAGCTCCTGATCTATTCTTCGTCCTATTTGGAGAACGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 333) |
| ABT1-95-<br>110 | GACATCCAGATGACCCAGTCACCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGGCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 334) |
| ABT1-95-<br>111 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGGACGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 335) |
| ABT1-95-<br>112 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGAACGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 336) |
| ABT1-95-<br>113 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 337) |
| ABT1-95-<br>114 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGGTGGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 338) |
| ABT1-95-<br>115 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTTTGCAGGGGTATCGTTGGCCTGTTACGTTCGGCCAAGGGACCAAGG<br>TGGAAATCAAACGG (SEQ ID NO: 339) |
| ABT1-95-<br>116 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTGTGCAGGGGTATCGTTGGCCTGTTACGTTCGGCCAAGGGACCAAGG<br>TGGAAATCAAACGG (SEQ ID NO: 340) |
| ABT1-95-<br>117 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTATGTACCACTGTGTCCAGGGGTATCGTTGGCCTGTTACGTTCGGCCAAGGGACCAAGG<br>TGGAAATCAAACGG (SEQ ID NO: 341) |
| ABT1-95-<br>118 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTTCGCAGGGGTATCGTTGGCCTGTTACGTTCGGCCAAGGGACCAAGG<br>TGGAAATCAAACGG (SEQ ID NO: 342) |
| ABT1-95-<br>119 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTGAGCAGGGGTATCGTTGGCCTGTTACGTTCGGCCAAGGGACCAAGG<br>TGGAAATCAAACGG (SEQ ID NO: 343) |
| ABT1-95-<br>120 | GACATCCAGATGACCCAGTCTCCATCCTCCCTGTCTGCATCTGTAGGAGACCGTGTCACCAT<br>CACTTGCCGGGCAAGTCAGCCGATTGCGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGTGTATCGTTGGCCTGTTACGTTCGGCCAAGGGACCAAGG<br>TGGAAATCAAACGG (SEQ ID NO: 344) |
| ABT1-95-<br>121 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATGAGTGGCCTGTTACGTTCGGCCAAGGGACCAAGG<br>TGGAAATCAAACGG (SEQ ID NO: 345) |
| ABT1-95-<br>122 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCATTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 346) |
| ABT1-95-<br>123 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATGCGTGGCCTGTTACGTTCGGCCAAGGGACCAAGG<br>TGGAAATCAAACGG (SEQ ID NO: 347) |
| ABT1-95-<br>124 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATATGTGGCCTGTTACGTTCGGCCAAGGGACCAAGG<br>TGGAAATCAAACGG (SEQ ID NO: 348) |
| ABT1-95-<br>125 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTCTGACGTTCGGCCAAGGGACCAAGG<br>TGGAAATCAAACGG (SEQ ID NO: 349) |
| ABT1-95-<br>126 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTTCGACGTTCGGCCAAGGGACCAAGG<br>TGGAAATCAAACGG (SEQ ID NO: 350) |
| ABT1-95-<br>127 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCGGCAGTCTGCAACCCGAAGATTT<br>TGCTACGTACCACTGTCAACAGGGGTATCGTTGGCCTATTACGTTCGGCCAAGGGACCAAGG<br>TGGAAATCAAACGG (SEQ ID NO: 351) |

TABLE 64-continued

DNA sequences for ABT1 and ABT2 dAbs

| dAb Name | DNA sequence |
|---|---|
| ABT1-95-128 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGGCACGTTCGGCCAAGGGACCAAGG TGGAAATCAAGCGG (SEQ ID NO: 352) |
| ABT1-95-129 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCACCCCGAAGATCT AGCTACGTACCACTGTCAACAGGGGTATCGTTGGCCTGTTACGTTCGGCCAAGGGACCAAGG TGGAAATCAAACGG (SEQ ID NO: 353) |
| ABT1-95-130 | GACATCCAGATGACCCAGTCTCCATCCTCCCTGTCTGCATCTGTAGGAGACCGTGTCACCAT CACTTGCCGGGCAAGTCAGCCGATTGTGCAGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACTACTGTCAACAGGGGTATCTGTGGCCTGTTACGTTCGGCCAAGGGACCAAGG TGGAAATCAAACGG (SEQ ID NO: 354) |
| ABT1-95-131 | GACATCCAGATGACCCAGTCTCCATCCTCCCTGTCTGCATCTGTAGGAGACCGTGTCACCAT CACTTGCCGGGCAAGTCAGCCGACTGTGCGGAACCTAAGGTGGTACCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 355) |
| ABT1-95-132 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA TAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCCGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 356) |
| ABT1-95-133 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTACCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCGCCAGGGGTATCGTTGGCCTGTTACGTTCGGCCAAGGGACCAAGG TGGAAATCAAACGG (SEQ ID NO: 357) |
| ABT1-95-134 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTGCCCAGGGGTATCGTTGGCCTGTTACGTTCGGCCAAGGGACCAAGG TGGAAATCAAACGG (SEQ ID NO: 358) |
| ABT1-95-135 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATTCCTGGCCTGTTACGTTCGGCCAAGGGACCAAGG TGGAAATCAAACGG (SEQ ID NO: 359) |
| ABT1-95-136 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCACCCCGAAGATCT AGCTACGTACCACTGTCAACAGGGGTATGGCTGGCCTGTTACGTTCGGCCAAGGGACCAAGG TGGAAATCAAACGG (SEQ ID NO: 360) |
| ABT1-95-137 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCTGTGGCCTGTTACGTTCGGCCAAGGGACCAAGG TGGAAATCAAACGG (SEQ ID NO: 361) |
| ABT1-95-139 | GACATCCAGATGACCCAGTCTCCATCCTCCCTGTCTGCATCTGTAGGAGACCGTGTCACCAT CACTTGCCGGGCAAGTCAGCCAGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC |

TABLE 64-continued

DNA sequences for ABT1 and ABT2 dAbs

| dAb Name | DNA sequence |
|---|---|
| | AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 362) |
| ABT1-95-<br>140 | GACATCCAGATGACCCAGTCTCCATCCTCCCTGTCTGCATCTGTAGGAGACCGTGTCACCAT<br>CACTTGCCGGGCAAGTCAGGGCATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 363) |
| ABT1-95-<br>141 | GACATCCAGATGACCCAGTCTCCATCCTCCCTGTCTGCATCTGTAGGAGACCGTGTCACCAT<br>CACTTGCCGGGCAAGTCAGCCGATTTTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 364) |
| ABT1-95-<br>142 | GACATTCAGATGACCCAGTCTCCATCCTCCCTGTCTGCATCTGTAGGAGACCGTGTCACCAT<br>CACTTGCCGGGCAAGTCAGCCGATTACCCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 365) |
| ABT1-95-<br>143 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCACGTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 366) |
| ABT1-95-<br>144 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCTGGGA<br>AAGCCCCTAAGCTCCTGATCTATTCTTCGTCCTATTTGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 367) |
| ABT1-95-<br>145 | GACATCCAGATGACCCAGTCTCCATCCTCCCTGTCTGCATCTGTAGGAGACCATGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGTCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 368) |
| ABT1-95-<br>146 | GACATCCAGATGACCCAGTCTCCATCCTCCCTGTCTGCATCTGTAGGAGACCGTGTCACCAT<br>CACTTGCCGGGCAAGTCAGAACATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 369) |
| ABT1-95-<br>147 | GACATCCAGATGACCCAGTCTCCATCCTCCCTGTCTGCATCTGTAGGAGACCGTGTCACCAT<br>CACTTGCTGGGCAAGTCAGGGGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 370) |
| ABT1-95-<br>148 | GACATCCAGATGACCCAGTCTCCATCCTCCCTGTCTGCATCTGTAGGAGACCGTGTCACCAT<br>CACTTGCCGGGCAAGTCAGACCATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 371) |
| ABT1-95-<br>149 | GACATCCAGATGACCCAGTCTCCATCCTCCCTGTCTGCATCTGTAGGAGACCGTGTCACCAT<br>CACTTGCCGGGCAAGTCAGGCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 372) |
| ABT1-95-<br>150 | GACATCCAGATGACCCAGTCTCCATCCTCCCTGTCTGCATCTGTAGGAGACCGTGTCACCAT<br>CACTTGCCGGGCAAGTCAGCACATTGTGCGGAACTTAAGGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 373) |
| ABT1-95-151 | GACATCCAGATGACCCAGTCTCCATCCTCCCTGTCTGCATCTGTAGGAGACCGTGTCACCAT<br>CACTTGCCGGGCAGGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGACCAAGGGACCAAGG<br>TGGAAATCAAACGG (SEQ ID NO: 374) |
| ABT1-95-152 | GACATCCAGATGACCCAGTCTCCATCCTCCCTGTCTGCATCTGTAGGAGACCGTGTCACCAT<br>CACTTGCCGGGCAGGTCAGCCGATTCCGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 375) |
| ABT1-95-153 | GACATCCAGATGACCCAGTCTCCATCCTCCCTGTCTGCATCTGTAGGAGACCGTGTCACCAT<br>CACTTGCCGGGCAAGTCAGCCGATTATCCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGGTTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 376) |
| ABT1-95-154 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTCCTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 377) |
| ABT1-95-155 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCACCTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTC<br>CGCTACGTACCACTGTCAACAGGGGTATCGTTGGCCTGTTACGTTCGGCCAAGGGACCAAGG<br>TGGAAATCAAACGG (SEQ ID NO: 378) |
| ABT1-95-156 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCGCCTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTACAGGGGTATCGTTGGCCTGTTACGTTCGGCCAAGGGACCAAGG<br>TGGAAATCAAACGG (SEQ ID NO: 379) |
| ABT1-95-157 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCACGTCTTCGTCCTATTTGGAGCCCGGGGTCCCATCACGTTTC<br>AGTGGTAGTGGATCCGGGGCAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 380) |
| ABT1-95-158 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTTCTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 381) |
| ABT1-95-159 | GACATCCAGATGACCCAGTCTCCATCCTCCCTGTCTGCATCTGTAGGAGACCGTGTCACCA<br>TCACTTGCCGGGCAAGTCAGCCGATTGCGCGGAACTTAAGGTGGTATCAGCAGAAACCAGG<br>GAAAGCCCCTAAGCTCCTGATCTATTCTTCGTCCTATTTGGAGCCCGGGGTCCCATCACGT<br>TTCAGTGGTAGTGGATCCGGGACAGATTTCACTCTCACCATCAGCAGTCTGCAACCCGAAG<br>ATTTTGCTACGTACCACTGTCAACAGGTGTATCGTTGGCCTGTTACGTTCGGCCAAGGGAC<br>CAAGGTGGAAATCAAACGG (SEQ ID NO: 382) |
| ABT1-95-160 | GACATCCAGATGACCCAGTCTCCATCCTCCCTGTCTGCATCTGTAGGAGACCGTGTCACCA<br>TCACTTGCCGGGCAAGTCAGCCGATTGTGCGGAACTTAAGGTGGTATCAGCAGAAACCAGG<br>GAAAGCCCCTAAGCTCCTGATCTATTCTTCATCCTATTTGGAGCCCGGGGTCCCATCACGT<br>TTCAGTGGTAGTGGATCCGGGACAGATTTCACTCTCACCATCAGCAGTCTGCAACCCGAAG<br>ATTTTGCTACGTACCACTGTCAACAGGGGTATGTGTGGCCTGTTACGTTCGGCCAAGGGAC<br>CAAGGTGGAAATCAAACGG (SEQ ID NO: 383) |

TABLE 64-continued

DNA sequences for ABT1 and ABT2 dAbs

| dAb Name | DNA sequence |
|---|---|
| ABT1-95-161 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTCCGACGTTCGGCCAAGGGACCAAGG TGGAAATCAAACGG (SEQ ID NO: 384) |
| ABT1-95-162 | GACATCCAGATGACCCAGTCTCCATCCTCCCTGTCTGCATCTGTAGGAGACCGTGTCACCAT CACTTGCCGGGCAAGTAAGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 385) |
| ABT1-95-163 | GACATCCAGATGACCCAGTCTCCATCCTCCCTGTCTGCATCTGTAGGAGACCGTGTCACCAT CACTTGCCGGGCAAGTAGGCCGATTGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAGATCAAACGG (SEQ ID NO: 386) |
| ABT1-95-164 | GACATCCAGATGACCCAGTCTCCATCCTCCCTGTCTGCATCTGTAGGAGACCGTGTCACCAT CACTTGTCGGGCAAGTCAGCCGGGAGTGCGGAACTTAAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 387) |
| ABT1-95-165 | GACATCCAGATGACCCAGTCTCCATCCTCCCTGTCTGCATCTGTAGGAGACCGTGTCACCAT CACTTGCCGGGCAAGTCAGCCGATTGTGCGGAACATGAGGTGGTATCAGCAGAAACCAGGGA AAGCCCCTAAGCTCCTGATCTATTCTTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 388) |
| ABT1-95-166 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTAAGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 389) |
| ABT1-95-167 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTCGGTCCTATTTGGAGCCCGGGGTCCCATCACGTTTC AGTGGTAGTGGATCCGGGGCAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 390) |
| ABT1-95-168 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCCCCTAAGCTCCTGATCTATTCTTCGTCCTTTTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 391) |
| ABT1-95-169 | GACATCCAGATGACCCAGTCTCCATCCTCCCTGTCTGCATCTGTAGGAGACCGTGTCACCAT CACTTGCCGGGCAAGTCAGCCGATTGTGCGGAACTTAAGGTGGTATCAGCAGAAACCAGGGA AAGCTCCTAAGCTCCTGATCTATGCAGTGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 392) |
| ABT1-95-170 | GACATCCAGATGACCCAGTCTCCATCCTCCCTGTCTGCATCTGTAGGAGACCGTGTCACCAT CACTTGCCGGGCAAGTAGGCCGATTGTGCGGAACTTAAGGTGGTATCAGCAGAAACCAGGGA AAGCCCCTAAGCTCCTGATCTATGCGTCGTCCTATTTGGAGCCCGGGGTCCCATCACGTTTC AGTGGTAGTGGATCCGGGACAGATTTCACTCTCACCATCAGCAGTCTGCAACCCGAAGATTT TGCTACGTACCACTGTCAACAGGGGTATCGTTGGCCTGTTACGTTCGGCCAAGGGACCAAGG TGGAAATCAAACGG (SEQ ID NO: 393) |
| ABT1-95-171 | GACATCCAGATGACCCAGTCTCCATCCTCCCTGTCTGCATCTGTAGGAGACCGTGTCACCAT CACTTGCCGGGCAAGTAGGCCGATTGTGCGGAACTTAAGGTGGTATCAGCAGAAACCAGGGA AAGCCCCTAAGCTCCTGATCTATTCTGTGTCCTATTTGGAGCCCGGGGTCCCATCACGTTTC |

TABLE 64-continued

DNA sequences for ABT1 and ABT2 dAbs

| dAb Name | DNA sequence |
| --- | --- |
| | AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 394) |
| ABT1-95-<br>172 | GACATCCAGATGACCCAGTCTCCATCCTCCCTGTCTGCATCTGTAGGAGACCGTGTCACCAT<br>CACTTGCCGGGCAAGTAGGCCGATTGTGCGGAATTTAAGGTGGTATCAGCAGAAACCAGGGA<br>AAGCTCCTAAGCTCCTGATCTATGCAGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 395) |
| ABT1-95-<br>173 | GACATCCAGATGACCCAGTCTCCATCCTCCCTGTCTGCATCTGTAGGAGACCGTGTCACCAT<br>CTCTTGCCGGGCAAGTAGGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGCCAGGGGTATCGTTGGCCTGTTACGTTCGGCCAAGGGACCAAGG<br>TGGAAATCAAACGG (SEQ ID NO: 396) |
| ABT1-95-<br>174 | GACATCCAGATGACCCAGTCTCCATCCTCCCTATCTGCATCTGTAGGAGACCGTGTCACCAT<br>CACTTGCCGGGCAAGTAGGCCGATTGTGCGGAACTTAAGGTGGTATCAGCAGAAACCAGGGA<br>AAGCCCCTAAGCTCCTGATCTATTCTGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTGTTACGTTCGGCCAAGGGACCAAGG<br>TGGAAATCAAACGG (SEQ ID NO: 397) |
| ABT1-95-<br>175 | GACATCCAGATGACCCAGTCTCCATCCTCCCTGTCTGCATCTGTAGGAGACCGTGTCACCAT<br>CACTTGCCGGGCAAGTAGGCCGATTGTGCGGAACTTAAGGTGGTATCAGCAGAAACCAGGGA<br>AAGCCCCTAAGCTCCTGATCTATGCGTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTGTTACGTTCGGCCAAGGGACCAAGG<br>TGGAAATCAAACGG (SEQ ID NO: 398) |
| ABT1-95-<br>176 | GACATCCAGATGACCCAGTCTCCATCCTCCCTGTCTGCATCTGTAGGAGACCGTGTCACCAT<br>CACTTGCCGGGCAAGTAGGCCAATTGTGCGGAACTTAAGGTGGTATCAGCAGAAACCAGGGA<br>AAGCTCCTAAGCTCCTGATCTATGCAGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTGTTACGTTCGGCCAAGGGACCAAGG<br>TGGAAATCAAACGG (SEQ ID NO: 399) |
| ABT1-95-<br>177 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATGCGTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTGTTACGTTCGGCCAAGGGACCAAGG<br>TGGAAATCAAACGG (SEQ ID NO: 400) |
| ABT1-95-<br>178 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTGTTACGTTCGGCCAAGGGACCAAGG<br>TGGAAATCAAACGG (SEQ ID NO: 401) |
| ABT1-95-<br>179 | GACATCCAGATGACCCAGTCTCCATCCTCCCTGTCTGCATCTGTAGGAGACCGTGTCACCAT<br>CACTTGCCGGGCAAGTCAGCCGATTGTGCGGAACTTAAGGTGGTATCAGCAGAAACCAGGGA<br>AAGCCCCTAAGCTCCTGATCTATTCTTCGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGGCAGGGGTATCGTTGGCCTCCGACGTTCGGCCAAGGGACCAAGG<br>TGGAAATCAAACGG (SEQ ID NO: 402) |
| ABT1-95-<br>181 | GACATCCAGATGACCCAGTCTCCATCCTCCCTGTCTGCATCTGTAGGAGACCGTGTCACCAT<br>CACTTGCCGGGCTAGTAAGCCGATCGTGCGTAACATGAGGTGGTATCAGCAGAAACCAGGGA<br>AAGCCCCTAAGCTCCTGATCTATTCGGTGTCCTATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTTCAGGGGTATCGTTGGCCTCCTACATTCGGCCAAGGGACCAAGG<br>TGGAAATCAAACGG (SEQ ID NO: 403) |
| ABT1-95-<br>182 | GACATCCAGATGACCCAGTCTCCATCCTCCCTGTCTGCATCTGTAGGAGACCGTGTCACCAT<br>CACTTGCCGGGCTAGTAAGCCGGGTGTGCGTAACTTGAGGTGGTATCAGCAGAAACCAGGGA<br>AAGCCCCTAAGCTCCTGATCTATTCGGTGTCCTATTTGGAACCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTTCAGGGGTATCGTTGGCCTCCTACATTCGGCCAAGGGACCAAGG<br>TGGAAATCAAACGG (SEQ ID NO: 404) |
| ABT1-95-<br>183 | GACATCCAGATGACCCAGTCTCCATCCTCCCTGTCTGCATCTGTAGGAGACCGTGTCACCAT<br>CACTTGCCGGGCAAGTCGGACGATAGTGCGGAACTTACGTTGGTACCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCAAGGAGCTTTTTGGAGCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTACAGGGGTATCGTTGGCCTCCTACGTTCGGCCAAGGGACCAAGG<br>TGGAAATCAAACGG (SEQ ID NO: 405) |
| ABT1-95-<br>184 | GACATCCAGATGACCCAGTCTCCATCCTCCCTGTCTGCATCTGTAGGAGACCGTGTCACCAT<br>CACTTGCCGGGCAAGTCGGACGCCTGTGCGGAACTTACGTTGGTATCAGCAGAAACCAGGGA<br>AAGCCCCTAAGCTCCTGATCTATTCAAGGAGCTATTTGGAGCCGGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTACAGGGGTATCGTTGGCCTCCTACGTTCGGCCAAGGGACCAAGG<br>TGGAAATCAAACGG (SEQ ID NO: 406) |
| ABT1-95-<br>500 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATAATATCTCCAATTTGCAAAGTGGGGTCCCATCGCGTTTC<br>AGTGGCAGTGGATCTGGAACAGATTTCACTCTCACCATCAGCAGTCTGCAACCTGAAGATTT<br>TGCTACGTACCACTGTCAACAGGGGTATCGTTGGCCTGTTACGTTCGGCCAAGGGACCAAGG<br>TGGAAATCAAACGG (SEQ ID NO: 407) |
| ABT1-95-<br>501 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATAGTATTTCCAATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGTATCGTTGGCCTGTTACGTTCGGCCAAGGGACCAAGG<br>TGGAAATCAAACGG (SEQ ID NO: 408) |
| ABT1-95-<br>502 | GACATCCAGATGACCCAGTCTCCATCCTCCCTGTCTGTATCTGTAGGAGACCGTGTCACCAT<br>CACCTGCCGGGCAAGTCAGCCGATTCATGGGAATTTACGTTGGTATCAGCAGAAACCAGGGA<br>AAGCCCCTAAGCTCCTGATCTATAATGTGTCCAGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGTATCGTTGGCCTGTTACATTCGGCCAAGGGACCAAGG<br>TGGAAATCAAACGG (SEQ ID NO: 409) |
| ABT1-95-<br>503 | GACATCCAGATGACCCAGTCTCCATCCTCCCTGTCTGCATCTGTAGGAGACCGTGTCACCAT<br>CACTTGCCGGGCAAGTCAGCCGATTCATGGGAATTTACGTTGGTATCAGCAGAAACCAGGGA<br>AAGCCCCTAAGCTCCTGATCTATAATGTGTCCAGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGGTATCGTTGGCCTGTTACGTTCGGCGAGGGACCAAGG<br>TGGAAATCAAACGG (SEQ ID NO: 410) |
| ABT1-95-<br>A1 | GACATCCAGATGACCCAGTCTCCATCCTCCCTGTCTGCATCTGTAGGAGACCGTGTCACCAT<br>CACTTGCCGAGCCAGTCGGCCGGGTGTGAGGAACTTAAGGTGGTATCAGCAGAAACCAGGGA<br>AAGCCCCTAAGCTCCTGATCTATCATGTGAGCGATTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCGACAGGGGTATGTTTGGCCTGTTCCCTTCGACCAAGGGACCAAGG<br>TGGAAATCAAACGT (SEQ ID NO: 411) |
| ABT1-95-<br>A2 | GACATCCAGATGACCCAGTCTCCATCCTCCCTGTCTGCATCTGTAGGAGACCGTGTCACCAT<br>CACTTGCCGGATACTTCAGCCCCCTGGCAGGAACTTAAGGTGGTATCAGCAGAAACCAGGGA<br>AAGCCCCTAAGCTCCTGATCTATTCAAAGAGCTTTTTGGAGCCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCAACAGGGGTATCGTTGGCCTGTTACGTTCGGCCAAGGGACCAAGG<br>TGGAAATCAAACGT (SEQ ID NO: 412) |
| ABT1-95-<br>A3 | GACATCCAGATGACCCAGTCTCCATCCTCCCTGTCTGCATCTGTAGGAGACCGTGTCACCAT<br>CACTTGCCGGGCTAGTAAGCCGGGTGTGCGTAACATGAGGTGGTATCAGCAGAAACCAGGGA<br>AAGCCCCTAAGCTCCTGATCTATTCGGTGTCCTATTTGGAACCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTTCAGGGGTATCGTTGGCCTCCTACATTCGGCCAAGGGACCAAGG<br>TGGAAATCAAACGG (SEQ ID NO: 413) |
| ABT1-95-<br>A5 | GACATCCAGATGACCCAGTCTCCATCCTCCCTGTCTGCATCTGTAGGAGACCGTGTCACCAT<br>CACTTGCCGGGCAAGTCGGACGCCTGTGCGGAACTTACGTTGGTATCAGCAGAAACCAGGGA<br>AAGCCCCTAAGCTCCTGATCTATTCAAGGAGCTTTTTGGAGCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTCTACAGGGGTATCGTTGGCCTCCTACGTTCGGCCAAGGGACCAAGG<br>TGGAAATCAAACGG (SEQ ID NO: 414) |
| ABT1-95-<br>A6 | GACATCCAGATGACCCAGTCTCCATCCTCCCTGTCTGCATCTGTAGGAGACCGTGTCACCAT<br>CACTTGCCGGGCTAGTAAGCCGGGTGTGCGTAACATGAGGTGGTATCAGCAGAAACCAGGGA<br>AAGCCCCTAAGCTCCTGATCTATGCTAAATCCTATTTGGAGCCGGGGTCCCATCACGTTTC<br>AGTGGTAGTGGATCCGGGACAGATTTCACTCTCACCATCAGCAGTCTGCAACCCGAAGATTT<br>TGCTACGTACCACTGTAAACAGGGGTATCGTTGGCCAGTTCAGTTCGGCCAAGGGACCAAGG<br>TGGAAATCAAACGG (SEQ ID NO: 415) |

TABLE 64-continued

DNA sequences for ABT1 and ABT2 dAbs

| dAb Name | DNA sequence |
| --- | --- |
| ABT1-119 | GACATCCAGATGACCCAGTCTCCATCCTCCCTGTCTGCATCTGTAGGAGACCGTGTCACCAT<br>CACTTGCCGGGCAAGTCAGGCGATTGGTGAGTGGTTAGGTTGGTACCAGCAGAAACCAGGGA<br>AAGCCCCTAAGCTCCTGATCTATAGGACGTCCGTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACTTCTTTTTTTCCTCCTACGTTCGGCCAAGGGACCAAGG<br>TGGAAATCAAACGG (SEQ ID NO: 416) |
| ABT1-120 | GACATCCAGATGACCCAGTCTCCATCCTCCCTGTCTGCATCTGTAGGAGACCGTGTCACCAT<br>CACTTGCCGGGCAAGTCAGAATATTTCTGTGCTTTTACGTTGGTACCAGCAGAAACCAGGGA<br>AAGCCCCTAAGCTCCTGATCTATAATGCGTCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTGGCGGTTTAGTCCCCATACGTTCGGCCAAGGGACCAAGG<br>TGGAAATCAAACGG (SEQ ID NO: 417) |
| ABT1-121 | GACATCCAGATGACCCAGTCTCCATCCTCCCTGTCTGCATCTGTAGGAGACCGTGTCACCAT<br>CACTTGCCGGGCAAGTCAGCCGATTTATACTGAGTTATCTTGGTATCAGCAGAAACCAGGGA<br>AAGCCCCTAAGCTCCTGATCTATGGTTCGTCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCGTATCATCCTGTGACGTTCGGCCAAGGGACCAAGG<br>TGGAAATCAAACGG (SEQ ID NO: 418) |
| ABT1-122 | GACATCCAGATGACCCAGTCTCCATCCTCCCTGTCTGCATCTGTAGGAGACCGTGTCACCAT<br>CACTTGCCGGGCAAGTCAGCCGATTTGGACTGAGTTAAATTGGTATCAGCAGAAACCAGGGA<br>AAGCCCCTAAGCTCCTGATCTATGGGTCGTCCTCGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCTTATTTTCCTGCTACGTTCGGCCAAGGGACCAAGG<br>TGGAAATCAAACGG (SEQ ID NO: 419) |
| ABT1-122-18 | GACATCCAGATGACCCAGTCTCCATCCTCCCTGTCTGCATCTGTAGGAGACCGTGTCACCAT<br>CACTTGCCGGGCAAGTCAGCCGATTTGGACTGAGTTAAATTGGTATCAGCAGAAACCAGGGA<br>AAGCCCCTAAGCTCCTGGTCTATGGGTCGTCCTCGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCTTATTTTCCTGCTACGTTCGGCCAAGGGACCAAGG<br>TGGAAATCAAACGG (SEQ ID NO: 420) |
| ABT1-122-21 | GACATCCAGATGACCCAGTCTCCATCCTCCCTGTCTGCATCTGTAGGAGACCGTGTCACCAT<br>CACATGCCGGGCAAGTCAGCCGATTTGGACTGAGTTAAATTGGTATCAGCAGAAACCAGGGA<br>AAGCCCCTAAGCTCCTGATCTATGGGTCGTCCTCGTTGCAAAGTGGGGTCCCAACACGTTTC<br>AGTGGCAGTGGATCTGGGACAGATTTCACTCTCACCATCAGCAGTCTGCAACCTGAAGATTT<br>TGCTACGTACTACTGTCAACAGTTTGCTTATTTTCCTGCTACGTTCGGCCAAGGGACCAAGG<br>TGGAAATCAAACGG (SEQ ID NO: 421) |
| ABT1-122-511 | GACATCCAGATGACCCAGTCTCCATCCTCCCTGTCTGCATCTGTAGGAGACCGTGTCACCAT<br>CACTTGCCGGGCAAGTCAGCCGATTTGGACTGAGTTAAATTGGTATCAGCAGAAACCAGGGA<br>AAGCCCCTAAGCTCCTGATCTATGGGTCGTCCTCGTTGCAAAGAGGGGTCCCATCACGTTTC<br>AGTGGCAGTGGATCTGGGACAGATTTCACTCTCACCATCAGCAGTCTGCAACCTGAAGATTT<br>TGCTACGTACTACTGTAAACAGTTTGCTTATTTTCCTGCTACGTTCGGCCAAGGGACCAAGG<br>TGGAAATCAAACGG (SEQ ID NO: 422) |
| ABT1-122-750X | GACATCCAGATGACCCAGTCTCCATCCTCCCTGTCTGCATCTGTAGGAGACCGTGTCGCCAT<br>CACTTGCTCGGCATCTCAGCATATTTGGACTGAGATATCTTGGTATCAGCAGAAACCAGGGA<br>AAGCCCCTAAGCTCCTGATCTATGGCTCGGCCTCGCGGCAAAAGGGGTCCCATCACGTTTC<br>AGTGGCAGTGGATCTGGGACAGATTTCACTCTCACCATCAGCAGTCTGCAACCTGAAGATTT<br>TGCTACGTACTACTGTAAACAGTTTGCTTATTTTCCTAATACGTTCGGCCAAGGGACCAAGG<br>TGGAAATCAAACGGG (SEQ ID NO: 423) |
| ABT1-123 | GACATCCAGATGACCCAGTCTCCATCCTCCCTGTCTGCATCTGTAGGAGACCGTGTCACCAT<br>CACTTGCCGGGCAAGTCAGAGCATTTGGACGGAGTTAAAGTGGTACCAGCAGAAACCAGGGA<br>AAGCCCCTAAGCTCCTGATCTATGGTGCATCCCTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCTTATCATCCTCATACGTTCGGCCAAGGGACCAAGG<br>TGGAAATCAAACGG (SEQ ID NO: 424) |
| ABT1-124 | GACATCCAGATGACCCAGTCTCCATCCTCCCTGTCTGCATCTGTAGGAGACCGTGTCACCAT<br>CACTTGCCGGGCAAGTCAGTCGATTGAGGGTAATTTACGGTGGTACCAGCAGAAACCAGGGA<br>AAGCCCCTAAGCTCCTGATCTATAATGTGTCCCTTTTGCAAAGTGGGGTCCCATCACGTTTC<br>AGTGGCAGTGGATCTGGGACAGATTTCACTCTCACCATCCGCAGTCTGCAACCTGAAGATTT<br>TGCTACGTACTACTGTCAACAGGGGTATCGTTATCCTCCTACGTTCGGCCAAGGGACCAAGG<br>TGGAAATCAAACGG (SEQ ID NO: 425) |
| ABT1-125 | GACATCCAGATGACCCAGTCTCCATCCTCCCTGTCTGCATCTGTAGGAGACCGTGTCACCAT<br>CACTTGCCGGGCAAGTCAGTCGATTCAGAAGTTTTTAAATTGGTACCAGCAGAAACCAGGGA<br>AAGCCCCTAAGCTCCTGATCTATCGGGGTTCCGGGTTGCAAAGTGGGGTCCCAACACGTTTC |

TABLE 64-continued

DNA sequences for ABT1 and ABT2 dAbs

| dAb Name | DNA sequence |
| --- | --- |
| | AGTGGCAGTGGATCTGGGACAGATTTCACTCTCACCATCAGCAGTCTGCAACCTGAGGATTT<br>TGCTACGTACTACTGTCAACAGGAGTATCGGATGCCTCTTACGTTCGGCCAAGGGACCAAGG<br>TGGAAATCAAACGG (SEQ ID NO: 426) |
| ABT1-126 | GACATCCAGATGACCCAGTCTCCATCCTCCCTGTCTGCATCTGTAGGAGACCGTGTCACCAT<br>CACTTGCCGGGCAAGTCAGTCTATTTATAAGTATTTAAGTTGGTACCAGCAGAAACCAGGGA<br>AAGCCCCTATGCTCCTGATCTATAGGGGGTCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTATGCGTTTTCGCCTTTTACGTTCGGCCAAGGGACCAAGG<br>TAGAAATCAAACGG (SEQ ID NO: 427) |
| ABT1-127 | GACATCCAGATGACCCAGTCTCCATCCTCCCTGTCTGCATCTGTAGGAGACCGTGTCACCAT<br>CACTTGCCGGGCAAGTCAGAGTATTAGGTATTATTTAAATTGGTATCAGCAGAAACCAGGGA<br>AAGCCCCTAAGCTCCTGATCTATTGGGATTCCAAGTTGCAAAGTGGGGTCCCATCACGTTTC<br>AGTAGCAGTGGATCTGGGACAGATTTCACTCTCACCATCAGCAGTCTGCAACCTGAAGATTT<br>TGCTACGTACTACTGTCAACAGACTGCGTCGGCTCCTTTTACGTTCGGCCAAGGGACCAAGG<br>TGGAAATCAAACGG (SEQ ID NO: 428) |
| ABT1-128 | GACATCCAGATGACCCAGTCTCCATCCTCCCTGTCTGCATCTGTAGGAGACCGTGTCACCAT<br>CACTTGCCGGGCAAGTCAGCCTATTAGGGAGTTTTTACATTGGTATCAGCAGAAACCAGGGA<br>AAGCCCCTAAGCTCCTGATCTATAGGTCTTCCCGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGAGTATAGGTATCCTCTTACGTTCGGCCAAGGGACCAAGG<br>TGGAAATCAAACGG (SEQ ID NO: 429) |
| ABT1-129 | GACATCCAGATGACCCAGTCTCCATCCTCCCTGTCTGCATCTGTAGGGGACAGTGTCGCCAT<br>CACTTGCCGGGCAAGTCAGCCGATTGGGGCGTTTTTATCTTGGTACCAGCAGAAACCAGGGA<br>AAGCCCCTAAGCTCCTGATCTATGCGATTTCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCAGATGATTTCGCCTCGTACGTTCGGCCAAGGGACCAAGG<br>TGGAAATCAAACGG (SEQ ID NO: 430) |
| ABT1-130 | GACATCCAGATGACCCAGTCTCCATCCTCCCTGTCTGCATCTGTAGGAGACCGTGTCACCAT<br>CACTTGCCGGGCAAGTCAGGAGATTGGTTTGTGGTTATCTTGGTACCAGCAGAAATCAGGGA<br>AAGCCCCTAAGCTCCTGATCTATCGGCATTCCAGTTCGCAAAGTGGGGTTCCATCACGTTTC<br>AGTGGCAGTGGATCTGGGACAGATTTCACTCTCACCATCAGCAGTCTGCAACCTGAAGATTT<br>TGCTACGTACTACTGTCAACAGACTTATAAGGCGCCTTTTACGTTCGGCCAAGGGACCAAGG<br>TGGAAATCAAACGG (SEQ ID NO: 431) |
| ABT1-131 | GACATCCAGATGACCCAGTCTCCATCTTCCCTGTCTGCATCTGTAGGAGACCGTGTCACCAT<br>CACTTGCCGGGCAAGTCAGAGGATTAATGGGAATTTACGTTGGTACCAGCAGAAACCAGGGA<br>AAGCCCCTAAGCTCCTGATCTATTCTGTTTCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGTTATGATTGGCCTCCTACGTTCGGCCAAGGGACCAAGG<br>TGGAAACCAAACGG (SEQ ID NO: 432) |
| ABT1-132 | GACATCCAGATGACCCAGTCTCCATCCTCCCTGTCTGCATCTGTAGGAGACCGTGTCACCAT<br>CACTTGCCGGGCAAGTCAGAATATTGCTACGGCGTTACTTTGGTACCAGCAGAAACCAGGGA<br>AAGCCCCTAGGCTCCTGATCTATGATTCGTCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGATGTATTGGGTTCCTTTTACGTTCGGCCAAGGGACCAAGG<br>TGGAAATCAAACGG (SEQ ID NO: 433) |
| ABT1-133 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACGATGACTGCTCCTTTTACGTTCGGCCAAGGGACCAAGG<br>TGGAAATCAAACGG (SEQ ID NO: 434) |
| ABT1-134 | GACATCCAGATGACCCAGTCTCCATCCTCCCTGTCTGCATCTGTAGGAGACCGTGTCACCAT<br>CACTTGCCGGGCAAGTCAGCATATTTATGATATGTTATCGTGGTACCAGCTGAAACCAGGGA<br>AAGCCCCTAAGCTCCTGATCTATCGTACGTCCCTTTTGCAAAGTGGGTCCCATCACGTTTC<br>AGTGGCAGTGGATCTGGGACAGATTTCACTCTTACCATCAGCAGTCTGCAACCTGAAGATTT<br>TGCTACGTACTACTGTCAACAGAATCATCGGAGGCCTCATAGGTTCGGCCAAGGGACCAAGG<br>TGGAAATCAAACGG (SEQ ID NO: 435) |
| ABT1-135 | GACATCCAGATGACCCAGTCTCCATCCTCCCTGTCTGCATCTGTAGGAGACCGTGTCACCAT<br>CACTTGCCGGGCAAGTCAGTATATTGGTCGGAAGTTAAGGTGGTATCAGCAGAAACCAGGGA<br>AAGCCCTTAAGCTCCTGATCTATCGGACGTCCCGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACGGGGCAGCATCCTCATACGTTCGGCCAAGGGACCAAGG<br>TGGAAATCAAACGG (SEQ ID NO: 436) |
| ABT1-136 | GACATCCAGATGACCCAGTCTCCATCCTCCCTGTCTGCATCTGTAGGAGACCGTGTCACCAT<br>CACTTGCCGGGCAAGTCAGGATATTGCGAATAATTTAGTGTGGTACCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATAGGCATTCCTTTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGATGCAGCAGGCTCCTTTTACGTCCGGCCAAGGGACCAAGG<br>TGGAAATCAAACGG (SEQ ID NO: 437) |
| ABT1-141 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 438) |
| ABT1-141-1 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCAGAAACCAGGGA<br>AAGCCCCTAAGCTCCTGATCTATAGTGGTTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGCTCGGCCAAGGGACCAAGG<br>TGGAAATCAAACGG (SEQ ID NO: 439) |
| ABT1-141-2 | GACATCCAGATGACCCAGTCTCCATCCTCCCTGTCTGCATCTGTAGGAGACCGTGTCACCAT<br>CACTTGCCGGGCAAGTCAGTGGATACAGAAGCAGTTAGCGTGGTACCAGCAGAAACCAGGGA<br>AAGCCCCTAAGCTCCTGATCTATAGTGCGCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGCTCGGCCAAGGGACCAAGG<br>TGGAAATCAAACGG (SEQ ID NO: 440) |
| ABT1-141-3 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCAGAAACCAGGGA<br>AAACCCCTAAGCTCCTGATCTATAGTCAGTCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 441) |
| ABT1-141-6 | GACATCCAGATGACCCAGTCTCCATCCTCCCTGTCTGCATCCGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTGTCTACAGCATCTGAGGGTGCCTTTTACGTTCGGCCAAGGGACCAAGG<br>TGGAAATCAAACGG (SEQ ID NO: 442) |
| ABT1-141-7 | GACATCCAGATGACCCAGTCTCCATCCTCCCTGTCTGCATCTGTAGGAGACCGTATCACCAT<br>CACTTGCCGGGCAAGTCAGTGGATTCAGAAGCAGTTAGCGTGGTATCAGCTGAAACCAGGGA<br>AAGCCCCTAAGCTCCTGATCTATTCTTCGTCCTATTTGCAAAGTGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 443) |
| ABT1-141-8 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCTGAAACCAGGGA<br>AAGCCCCTAAGCTCCTGATCTATAGTTCTTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 444) |
| ABT1-141-9 | GACATCCAGGTGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCAGAAACCAGGGA<br>AAGCCCCTAAGCTCCTGATCTATTCTTCTTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 445) |
| ABT1-141-10 | GACATCCAGATGACCCAGTCTCCATCCTCCCTGTCTGCATCTGTAGGAGACCGTGTCACCAT<br>CACTTGCCGGGCAAGTCAGTGGATTCAGCAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTCGCTTCGGGTGCCCTTTACGTTCGGCCAAGGGACCAAGG<br>TGGAAATCAAACGG (SEQ ID NO: 446) |
| ABT1-141-11 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTGGATGAGTCCTCCTCGTACGTTCGGCCAAGGGACCAAGG<br>TGGAAATCAAACGG (SEQ ID NO: 447) |

TABLE 64-continued

DNA sequences for ABT1 and ABT2 dAbs

| dAb Name | DNA sequence |
| --- | --- |
| ABT1-141-12 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGATCGGCCAAGGGACCAAGG TGGAAATCAAACGG (SEQ ID NO: 448) |
| ABT1-141-13 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATTTGAGGACTCCTCCGACGTTCGGCCAAGGGACCAAGG TGGAAATCAAACGG (SEQ ID NO: 449) |
| ABT1-141-14 | GATATTCAGATGACCCAGAGCCCGAGCAGCCTGAGCGCGAGCGTGGGCGATCGTGTGACCAT TACCTGCCGTGCGAGCCAGTGGATTCAGAAACAGCTGGCGTGGTATCAGCAGAAACCGGGCA AAGCGCCGCGTCTGCTGATTTATAGCAGCAGCTATCTGCAGAGCGGCGTGCCGAGCCGTTTT AGCGGCAGCGGCAGCGGCACCGATTTTACCCTGACCATTAGCAGCCTGCAGCCGGAAGATTT TGCGACCTATTATTGCCAGCAGAACCTGAGCGTGCCGTTTACCTTTGGCCAGGGCACCAAAG TGGAAATTAAACGT (SEQ ID NO: 450) |
| ABT1-141-15 | GACATCCAGATGACCCAGTCTCCACCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGTTCGGCCAAGGGACCAAGG TGGAAATCAAACGG (SEQ ID NO: 451) |
| ABT1-141-16 | GACATCCAGATGACCCAGTCTCCATCCTCCCTGTCTGCATCTGTAGGAGACCGTGTCGCCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACATCATCTGAGGGTGCCTTTTACGTTCGGCCAAGGGACCAAGG TGGAAATCAAACGG (SEQ ID NO: 452) |
| ABT1-141-17 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGCTGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGTTCGGCCAAGGGACCAAGG TGGAAATCAAACGG (SEQ ID NO: 453) |
| ABT1-141-18 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGTCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGTTCGGCCAAGGGACCAAGG TGGAAATCAAACGG (SEQ ID NO: 454) |
| ABT1-141-19 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTACCAGCAGAAACCAGGGA AAGCCCCTAAGCTCCTGATCTATTCGAGTTCCTGGTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGTTCGGCCAAGGGACCAAGG TGGAAATCAAACGG (SEQ ID NO: 455) |
| ABT1-141-20 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTACCAGCAGAAACCAGGGA AAGCCCCTAAGCTCCTGATCTATTCGGCTTCCTGGTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTGAGGGTGCCTTTTACGTTCGGCCAAGGGACCAAGG TGGAAATCAAACGG (SEQ ID NO: 456) |
| ABT1-141-21 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCAGATGTCGTCTCCTCGTACGTTCGGCCAAGGGACCAAGG TGGAAATCAAACGG (SEQ ID NO: 457) |
| ABT1-141-22 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC |

TABLE 64-continued

DNA sequences for ABT1 and ABT2 dAbs

| dAb Name | DNA sequence |
| --- | --- |
| | AGTGGCAGTGGATCTGGGACAGATTTCACTCTCACCATCAGCAGTCTGCAACCTGAAGATTT<br>TGCTACGTACTACTGTCAACAGCAGATGGCTCCTCCTCGTACGTTCGGCCAAGGGACCAAGG<br>TGGAAATCAAACGG (SEQ ID NO: 458) |
| ABT1-141-23 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCAGATGCAGCCTCCTCGTACGTTCGGCCAAGGGACCAAGG<br>TGGAAATCAAACGG (SEQ ID NO: 459) |
| ABT1-141-24 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGACTT<br>TGCTACGTACTACTGTCAACAGCATCTGAGGGTGCCTCCGACGTTCGGCCAAGGGACCAAGG<br>TGGAAATCAAACGG (SEQ ID NO: 460) |
| ABT1-141-25 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 461) |
| ABT1-141-27 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGGTCTTAGGCAGCCTATGACTTTCGGCCAAGGGACCAAGG<br>TGGAAATCAAACGG (SEQ ID NO: 462) |
| ABT1-141-28 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGCTCGGCCAAGGGACCAAGG<br>TGGAAATCAAACGG (SEQ ID NO: 463) |
| ABT1-141-29 | GACATCCAGGTGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCTGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 464) |
| ABT1-141-30 | GACATCCAGGTGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 465) |
| ABT1-141-31 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 466) |
| ABT1-141-32 | GACATCCAGATGACCCAGTCTCCATCCTCCCTGTCTGCATCTGTAGGAGACCGTATCACCAT<br>CACTTGCCGGGCAAGTCAGTGGATTCAGAAGCAGTTAGCGTGGTACCAGCTGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTATGACGTTCGGCCAAGGGACCAAGG<br>TGGAAATCAAACGG (SEQ ID NO: 467) |
| ABT1-141-33 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCTGAAACCAGGGA<br>AAGCCCCTAAGCTCCTGATCTATAGTTCTTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTATGACGTTCGGCCAAGGGACCAAGG<br>TGGAAATCAAACGG (SEQ ID NO: 468) |
| ABT1-141-34 | GACATCCAGACGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTGAGGGTGCCTATGACGTTCGGCCAAGGGACCAAGG<br>TGGAAATCAAACGG (SEQ ID NO: 469) |
| ABT1-141-<br>35 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTGCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 470) |
| ABT1-141-<br>42 | GACCTCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 471) |
| ABT1-141-<br>43 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCACCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 472) |
| ABT1-141-<br>44 | GACATCCAGATTACCCAGTCTCCATCATCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGATTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 473) |
| ABT1-141-<br>45 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGCGGATCTGGGACAGATTTCACTCTCACCATCAGTAGTCTGCAACTTGAAGATTT<br>TGCTACGTACTACTGTCAACAGCATCTTCGTGTTCCTATGACGCTCGGCCAAGGGACCAAGG<br>TGGAAATCAAACGG (SEQ ID NO: 474) |
| ABT1-141-<br>46 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AGCCCCTAAGCTCCTGATCTATTCTTCGTCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGTAATCAAACGG (SEQ ID NO: 475) |
| ABT1-141-<br>47 | GACATCCAGATGACCCAGTCTCCATCCTCCCTGTCTGCATCTGTAGGAGACCGTGTCACCAT<br>CACTTGCCGGGCAAATCAGTGGATTCAGAAGCAGTTAGCGTGGTATCAGCAGAAACCGGGA<br>AAGCCCCTAAGCTCCTGATCTATTCTTCGTCCCATTTGCAAAGTGGGGTCCCATCACGTTTC<br>AGTGGCAGTGGATCTGGGACAGATTTCACTCTCACCATCAGCAGTCTGCAACCTCAAGATTT<br>TGCTACGTACTACTGTCAACAGCATCTTCGTGTTCCTATGACGTTCGGCCAAGGGACCAAGG<br>TGGAAATCAAACGG (SEQ ID NO: 476) |
| ABT1-141-<br>48 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTTTTCTTCGTCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTTCGTACTACTGTCAACAGCATCTTCGTGTTCCTATGACGTTCGGCCAAGGGACCAAGG<br>TGGAAATCAAACGG (SEQ ID NO: 477) |
| ABT1-141-<br>49 | GACATCCAGATGACCCAGTCTCCATCCTCCCTGTCTGCATCTGTAGGAGACCGTGTCACCA<br>TCACTTGCCGGGCAAGTCAGTGGATTCAGAAGCAGTTAGCGTGGTATCAGCTGAAACCAGG<br>GAAAGCCCCTAAGCTCCTGATCTATTCTTCGTCCCATTCGCAAAGTGGGGTCCCATCACGT<br>TTCAGTGGCAGTGGATCTGGGACAGATTTCACTCTCACCATCAGCAGTCTGCAACCTGAAG<br>ATTTTGCTACGTACTACTGTCAACAGCATCTTCGTGTTCCTATGACGTTCGGCCAAGGGAC<br>CAAGGTGGAAATCAAACGG (SEQ ID NO: 478) |
| ABT1-141-<br>50 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAACCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAATG<br>TGGAAATCAAACGG (SEQ ID NO: 479) |

TABLE 64-continued

DNA sequences for ABT1 and ABT2 dAbs

| dAb Name | DNA sequence |
|---|---|
| ABT1-141-51 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGTCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGGAACCTGAAGATTT TGCTACGTACTACTGTCAACAGCATCTTCGTGTTCCTATGACGTTCGGCCAAGGGACCAAGG TGGTAATCAAACGG (SEQ ID NO: 480) |
| ABT1-141-52 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTTCGTGTTCCTATGACGCTCGGCCAAGGGACCAAGG TGGAAATCAAACGG (SEQ ID NO: 481) |
| ABT1-141-53 | GACATCCAGATGACCCAGTCTCCATCCTCCCTGTCTGCATCTGTAGGAGACCGTGTCACCA TCACTTGCCGGGCAAGTCAGTGGATTCAGAAGCAGTTAGCGTGGTATCAGCTGAAACCAGG GAAAACCCCTAAGCTCCTGATCTTTTCTTCGTCCTATTTGCAAAGTGGGGTCCCATCACGT TTCAGTGGCAGTGGATCTGGGACAGATTTCACTCTCACCATCAGCAGTCTGCAACCTGAAG ATTTTGCTACGTACTACTGTCAACAGCATCTTCGTGTTCCTATGACGTTCGGCCAAGGGAC CAAGGTGGAAATCAAACGG (SEQ ID NO: 482) |
| ABT1-141-54 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCCATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTTCGTGTTCCTATGACGTTTGGCCAAGGGACCAAGG TGGAAATCAAACGG (SEQ ID NO: 483) |
| ABT1-141-70 | GACATCCAGATGACCCAGTCTCCATCCTCCCTGTCTGCATCTGTAGGAGACCGTGTCACCAT CACTTGCCGGGCAAGTCAGTGGATTCAGAAGCAGTTAGCGTGGTATCAGCAGAAACCAGGGA AAGCCCCTAAGCTCCTGATCTATTCTTCGTCCCATTTGCAAAGTGGGGTCCCATCACGTTTC AGTGGCAGTGGATATGGGACAGATTTCACTCTCACCATCAGCAGTCTGCAACCAGAAGATTT TGCTACGTACTACTGTCAACAGCATCTTCGTGTTCCTATGACGTTCGGCCAAGGGACCAAGG TGGAAATCAAACGG (SEQ ID NO: 484) |
| ABT1-141-75 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCAGGGA AAGCCCCTAAGCTCCTGATCTATTCTTCGTCCTATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTTCGTGTTCCTATGACGTTCGGCCAAGGGACCAAGG TGGAAATCAAACGG (SEQ ID NO: 485) |
| ABT1-141-76 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCGGGGA AAGCCCCTAAGCTCCTGATCTATTCTTCGTCCCATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTTCGTGTTCCTATGACGTTCGGCCAAGGGACCAAGG TGGAAATCAAACGG (SEQ ID NO: 486) |
| ABT1-141-77 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCGGGGA AAGCCCCTAAGCTCCTGATCTTCTCTTCGTCCCATTTGCAAAGTGGGGTCCCATCACGTTTC AGTGGCAGTGGATCTGGGACAGATTTCACTCTCACCATCAGCAGTCTGCAACCTCAAGATTT TGCTACGTACTACTGTCAACAGCATCTTCGTGTTCCTATGACGTTCGGCCAAGGGACCAAGG TGGAAATCAAACGG (SEQ ID NO: 487) |
| ABT1-141-78 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCGGGGA AAGCCCCTAAGCTCCTGATCTATTCTTCGTCCCATTTGCAAAGTGGGGTCCCATCACGTTTC AGTGGCAGTGGATACGGGACAGATTTCACTCTCACCATCAGCAGTCTGCAACCTCAAGATTT TGCTACGTACTACTGTCAACAGCATCTTCGTGTTCCTATGACGTTCGGCCAAGGGACCAAGG TGGAAATCAAACGG (SEQ ID NO: 488) |
| ABT1-141-79 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCGGGGA AAGCCCCTAAGCTCCTGATCTTCTCTTCGTCCCATTTGCAAAGTGGGGTCCCATCACGTTTC AGTGGCAGTGGATCTGGGACAGATTTCACTCTCACCATCAGCAGTCTGCAACCTGAAGATTT TGCTACGTACTACTGTCAACAGCATCTTCGTGTTCCTATGACGTTCGGCCAAGGGACCAAGG TGGAAATCAAACGG (SEQ ID NO: 489) |
| ABT1-141-80 | GACATCCAGATGACCCAGTCTCCATCCTCCCTGTCTGCATCTGTAGGAGACCGTGTCACCAT CACTTGCCGGGCAAATCAGTGGATTCAGAAGCAGTTAGCGTGGTATCAGCAGAAACCGGGGA AAGCCCCTAAGCTCCTGATCTATTCTTCGTCCCATTTGCAAAGTGGGGTCCCATCACGTTTC |

TABLE 64-continued

DNA sequences for ABT1 and ABT2 dAbs

| dAb Name | DNA sequence |
| --- | --- |
| | AGTGGCAGTGGATACGGGACAGATTTCACTCTCACCATTAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 490) |
| ABT1-141-<br>500 | GACATCCAGATGACCCAGTATCCATCCTCCCTGTCTGCATCTGTAGGAGACCGTGTCACCAT<br>CACTTGCCGGGCAAGTCAGTGGATTCAGAAGCAGCTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCGGCCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 491) |
| ABT1-141-<br>501 | GACATCTTGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTACTCCGCCTCCACGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTGGCTGTCTATTCCTCATACGTTCGGCCAAGGGACCAAGG<br>TGGGAATCAAACGG (SEQ ID NO: 492) |
| ABT1-141-<br>502 | GACATCCAGGTGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTACCAGCAGAAACCAGGGA<br>AAGCCCCCAGGCTCCTGATCTATGCTGCGTCCACGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCCACGTACTACTGTCAACAGACTTTGAGGAGCCCTTTTACGTTCGGCCAAGGGACCAAGG<br>TGGAAATCAAACGG (SEQ ID NO: 493) |
| ABT1-141-<br>503 | GACATCCAGATGACCCAGTCCCCATCCTCCCTGTCTGCATCTGTAGGAGGCCGTGTCACCAT<br>CACTTGCCGGGCAAGTCAGTGGATTCAGAAGCAGTTAGCGTGGTATCAGCAGAAACCAGGGA<br>AAGCCCCCAAGCTCCTGGTCTATGCGGCTTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGTCTGAGGGCGCCTTTTACGTTCGGCCAAGGGACCAAGG<br>TGGAAATCAAACGG (SEQ ID NO: 494) |
| ABT1-141-<br>504 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATGAGCAGAAACCAGGGG<br>GAGCCCCTAAGCTCCTGATCTATTCTTCGTCCTATTTGCAAAGTGGGGTCCCATCACGTTTC<br>AGTGGCAGTGGATCTGGGACAGATTTGACTCTCACCATCAGCAGTCTGCAACCTGAAGATTT<br>TGCTACGTACTACTGTCAACAGAATCTGTCGGTTCCTTTTACGTTCGGCCAAGGGACCAAGG<br>TGGAAATCAAACGG (SEQ ID NO: 495) |
| ABT1-141-<br>505 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAATCTGTCGGTTCCTTTTACGTTCGGCCAAGGGACCAAGG<br>TGGAAATCAAACGG (SEQ ID NO: 496) |
| ABT1-141-<br>506 | GACATCCAGATGACCCAGTCCCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAGCCAGGGA<br>GAGCCCCTAGGCTCCTGATCTATTCTTCGTCCTATTTGCAAAGCGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAATCTGTCGGTTCCTTTTACGTTCGGCCAAGGGACCAAGG<br>TGGAAATCAAACGG (SEQ ID NO: 497) |
| ABT1-141-<br>507 | GATATTCAGATGACCCAGAGCCCGAGCAGCCTGAGCACCAGCGTGGGCGATCGTGTGACCAT<br>TACCTGCCGTGCGAGCCTGTGGATTCAGAAACAGCTGGCGTGGTATCAGCAGAAACCGGGCA<br>AAGCGCCGAAACTGCTGATTTATGCGGGCAGCTTTCTGCAGAGCGGCGTGCCGAGCCGTTTT<br>AGCGGCAGCGGCAGCGGCACCGATTTTGCGCTGACCATTAGCAGCCTGCAGCCGGAAGATTT<br>TGCGACCTATTATTGCCAGCAGACCCTGTTTTATCCGTTTACCTTTGGCCAGGGCACCAAAG<br>TGGAAATTAAACGT (SEQ ID NO: 498) |
| ABT1-141-<br>508 | GATATTCAGATGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCC<br>GTGCGCCGAAACTGCTGATTTATAGCAGCAGCTATCTGCAGAGCGGCGTGCCGAGCCGTTTT<br>AGCGGCAGCGGCAGCGGCACCGATTTTACCCTGACCATTAGCAGCCTGCAGCCGGAAGATTT<br>TGCGGCGTATTATTGCCAGCAGCATCTGCGTGTGCCGAACACCTTTAGCCAGGGCACCAAAG<br>TGGAAGTGAAACGT (SEQ ID NO: 499) |
| ABT1-141-<br>509 | GATATTCAGATGACCCAGAGCCCGAGCAGCCTGAGCGCGAGCGTGGGCGATCGTGTGACCAT<br>TACCTGCCGTGCGAACCAGTGGATTCAGAAACAGCTGGCGTGGTATCAGCAGAAACCGGGCA<br>AAGCGCTGAAACTGCTGGTGTATAGCGCGAGCTATCTGCAGAGCGGCGTGCCGAGCCGTTTT<br>AGCGGCAGCGGCAGCGGCACCGATTTTACCCTGACCATTAGCAGCCTGCAGCCGGAAGATTT<br>TGCGACCTATTATTGCCAGCAGCATCTGCGTGTGCCGTTTACCTTTGGCCAGGGCACCAAAG<br>TGGAAATTAAACGT (SEQ ID NO: 500) |
| ABT1-141-<br>510 | GATATTCAGATGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCA |

TABLE 64-continued

DNA sequences for ABT1 and ABT2 dAbs

| dAb Name | DNA sequence |
| --- | --- |
| | AAGCGCCGAAACTGCTGGTGTATGCGGCGAGCTGGCTGCAGAGCGGCGTGCCGAGCCGTTTT<br>AGCGGCAGCGGCAGCGGCACCGATTTTACCCTGACCATTAGCAGCCTGCAGCCGGAAGATTT<br>TGCGACCTATTATTGCCAGCAGAGCCTGCGTGCGCCGTTTACCTTTGGCCAGGGCACCAAAG<br>TGGAAATTAAACGT (SEQ ID NO: 501) |
| ABT1-141-511 | GATATTCAGATGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCA<br>AAACCCCGAAACTGCTGATTTATAGCAGCAGCTATCTGCAGAGCGGCATTCCGAGCCGTTTT<br>AGCGGCAGCGGCAGCGGCACCGATTTTACCCTGACCATTAGCAGCCTGCAGCCGGAAGATTT<br>TGCGACCTATTATTGCCAGCAGCATCTGCGTGTGCCGTTTACCTTTGGCCAGGGCACCAAAG<br>TGGAAATTAAACGT (SEQ ID NO: 502) |
| ABT1-141-512 | GATATTCAGATGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCA<br>AAGTGCCGAAACTGCTGATTTATAGCAGCAGCTATCTGCAGAGCGGCGTGCCGAGCCGTTTT<br>AACGGCAGCGGCAGCGGCACCGATTTTACCCTGACCATTAGCAGCCTGCAGCCGGAAGATTT<br>TGCGACCTATTATTGCCAGCAGACCCTGACCGTGCCGTTTACCTTTGGCCAGGGCACCAAAG<br>TGGAAATTAAACGT (SEQ ID NO: 503) |
| ABT1-141-513 | GATATTCAGGTGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCA<br>AAGCGCCGCGTCTGCTGATTTATGCGGCGAGCGCGCTGCAGAGCGGCGTGCCGAGCCGTTTT<br>AGCGGCGGCGGCAGCGGCACCGATTTTACCCTGACCATTAGCCGGCCTGCAGCCGGAAGATTT<br>TGCGACCTATTATTGCCAGCAGACCCTGCGTAGCCCGTTTACCTTTGGCCAGGGCACCAAAG<br>TGGAAATTAAACGT (SEQ ID NO: 504) |
| ABT1-141-514 | GATATTCAGATGACCCAGAGCCCGAGCAGCCTGAGCGCGAGCGTGGGCGATCGTGTGACCAT<br>TACCTGCCGTGCGAGCCAGTGGATTCAGAAACAGCTGGCGTGGTATCAGCAGAAACCGGGCA<br>AAGCGCCGCGTCTGCTGATTTATAGCAGCAGCTATCTGCAGAGCGGCGTGCCGAGCCGTTTT<br>AGCGGCAGCGGCAGCGGCACCGATTTTACCCTGACCATTAGCAGCCTGCAGCCGGAAGATTT<br>TGCGACCTATTATTGCCAGCAGAACCTGAGCGTGCCGTTTACCTTTGGCCAGGGCACCAAAG<br>TGGAAATTAAACGT (SEQ ID NO: 505) |
| ABT1-141-516 | GACATCCAGATGACCCAGTCTCCATCCTCCCTGTCTGCATCTGTAGGAGACCGTGTCACCAT<br>CAATTGCCGGGCAAATCAGTGGATTCAGAAGCAGTTAGCGTGGTACCAGCAGAAACCAGGGA<br>AGGCCCTTAAGCTCCTGGTCTATAGTGCGTCCTATCTGCAAAGTGGGGTCCCATCACGTTTC<br>AGTGGCAGTGGATCTGGGTCAGATTTCACTCTCACCATCAGCAGTCTGCAACCTGAAGATTT<br>TGCTACGTACTACTGTCAACAGCATCTGAGGGTGCCTTTTACGTTCGGCCAAGGGACCAAGG<br>TGGAAATCAAACGG (SEQ ID NO: 506) |
| ABT1-141-519 | GACATCCAGATGACCCAGTCTCCATCCTCCCTGTCTGCATCTGTAGGAGACCGTGTCACCTT<br>CACTTGCCGGGCAAGTCAGTGGATTCAGAAGCAGTTAGCGTGGTACCAGCAGAAACCAGGGA<br>AAGTCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTTCTGTCAACAGACTTTGACTGTGCCTTTTACGTTCGGCCAAGGGACCAAGG<br>TGGAAATCAAACGG (SEQ ID NO: 507) |
| ABT1-141-520 | GACATCCAGATGACCCAGTCTCCATCCTCCCTGTCTGCATCTGTAGGAGACCGTGTCACCAT<br>CAATTGCCGGGCAAATCAGTGGATTCAGAAGCAGTTAGCGTGGTACCAGCAGAAACCAGGGA<br>AGGCCCTTAAGCTCCTGGTCTATAGTGCGTCCTATCTGCAAAGTGGGGTCCCATCAAGGTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 508) |
| ABT1-141-521 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCGTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 509) |
| ABT1-141-522 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCGTCGTCCTGGTGGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 510) |
| ABT1-141-523 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCGTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 511) |

TABLE 64-continued

DNA sequences for ABT1 and ABT2 dAbs

| dAb Name | DNA sequence |
|---|---|
| ABT1-141-524 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCCTCGTCCTGGTTGCAAAGGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 512) |
| ABT1-141-525 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCCTCGTCCTGGTTGCAAAGTGGGGCCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 513) |
| ABT1-141-526 | GACATCCAGATGACCCAGTCTCCATCCTCCCTGTCTGCATCTGTAGGAGACCGTGTCGCCAT<br>CACTTGCCGGGCAAGTCAGTGGATTCAGAAGCAGTTAGCGTGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 514) |
| ABT1-141-527 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTCTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 515) |
| ABT1-141-528 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGATGCATAAGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 516) |
| ABT1-141-529 | GACATCCAGATGACCCAGTCTCCATCCTCCCTGTCTGCATCTGTAGGAGACCGTGTCACCAT<br>CACTTGCCGGGCAAACCAGTGGATTCAGAAGCAGTTAGCGTGGTATCAGCAGAAACCAGGGA<br>AAGCCCCTAAGCTCCTGATCTATAGCTCGTCCACGTTGCAAAGTGGGACCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGCTCGGCCAAGGGACCAAGG<br>TGGAAATCAAACGG (SEQ ID NO: 517) |
| ABT1-141-530 | AACATCCAGATGACCCAGTCTCCATCCTCCCTGTCTGCATCTGTAGGAGACCGTGTCACCAT<br>CACTTGCCGGGCATCGGAGTGGATTCAGAAGCAGTTAGCGTGGTATCAGCAGAAACCAGGGA<br>AAGCCCCTAAGCTCCTGATCTATAGCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 518) |
| ABT1-141-531 | GACATCCAGATGACCCAGTCTCCATCCTCCCTGTCTGCATCTGTAGGAGACCGTGTCACCAT<br>CACTTGCCGGGCAGACCAGTGGATTCAGAAGCAGTTAGCGTGGTATCAGCAGAAACCAGGGA<br>AAGCCCCTAAGCTCCTGATCTATAGCTCGTCCTGGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 519) |
| ABT1-141-532 | GACATCCAGGTGACCCAGTCTCCATCCTCCCTGTCTGCATCTGTAGGAGACCGTGTCACCAT<br>CACTTGCCGGGCAGACCAGTGGATTCAGAAGCAGTTAGCGTGGTATCAGCAGAAACCAGGGA<br>AAGCCCCTAAGCTCCTGATCTATAGCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 520) |
| ABT1-141-533 | GACATCCAGATGACCCAGTCTCCATCCTCCCTGTCTGCATCTGTAGGAGACCGTGTCACCAT<br>CACTTGCCGGACGAACCAGTGGATTCAGAAGCAGTTAGCGTGGTATCAGCAGAAACCAGGGA<br>AAGCCCCTAAGCTCCTGATCTATTCTTCGTCCCATAACCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 521) |
| ABT1-141-534 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGAACCATCCGCAAAGTGGGGTCCCATCACGTTTC |

TABLE 64-continued

DNA sequences for ABT1 and ABT2 dAbs

| dAb Name | DNA sequence |
|---|---|
| | AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAGTCAAACGG (SEQ ID NO: 522) |
| ABT1-141-535 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGGCGCATGCGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 523) |
| ABT1-141-536 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGGCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 524) |
| ABT1-141-537 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGATGCATACCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 525) |
| ABT1-141-538 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGAACCATTCCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 526) |
| ABT1-141-539 | GACATCCAGATGACCCAGTCTCCATCCTCCCTGTCTGCATCTGTAGGAGACCGTGTCACCAT<br>CACTTGCCGGGCGAACGAGTGGATTCAGAAGCAGTTAGCGTGGTATCAGCAGAAACCAGGGA<br>AAGCCCCTAAGCTCCTGATCTATTCTTCGATGCATCCCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 527) |
| ABT1-141-541 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGATGCATCCGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 528) |
| ABT1-141-542 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGATGCATTCCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 529) |
| ABT1-141-543 | GACATCCAGATGACCCAGTCTCCATCCTCCCTGTCTGCATCTGTAGGAGACCGTGTCACCAT<br>CACTTGCCGGTCGAACGAGTGGATTCAGAAGCAGTTAGCGTGGTATCAGCAGAAACCAGGGA<br>AAGCCCCTAAGCTCCTGATCTATTCTTCGACCCATCGGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 530) |
| ABT1-141-544 | GACATCCAGATGACCCAGTCTCCATCCTCCCTTTCTGCATCTGTAGGAGACCGTGTCACCAT<br>CACTTGCCGGGCAAGTCAGTGGATTCAGAAGCAGTTAGCGTGGTATCAGCTGAAACCAGGGA<br>AAGCCCCTAAGCTCCTGATCTATTCTTCGTCATATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 531) |
| ABT1-141-545 | GACATCCAGATGACCCAGTCTCCATCCTCCCTGTCTGCATCTGTAGGAGACCGTGTCACCAT<br>CACTTGCCGGGCAAACCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 532) |
| ABT1-141-546 | GACATCCAGATGACCCAGTCTCCATCCTCCCTGTCTGCATCTGTAGGAGACCGTGTCACCAT<br>CACTTGCCGGGCATCGGAGTGGATTCAGAAGCAGTTAGCGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATTCGTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 533) |
| ABT1-141-547 | GACATCCAGATGACCCAGTCTCCATCCTCCCTGTCTGCATCTGTAGGAGACCGTGTCACCAT<br>CACTTGCCGGGCAAACTCGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTCTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 534) |
| ABT1-141-548 | GACATCCAGATGACCCAGTCTCCATCCTCCCTGTCTGCATCTGTAGGAGACCGTGTCACCAT<br>CACTTGCCGGGCAGACCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 535) |
| ABT1-141-549 | GACATCCAGATGACCCAGTCTCCATCCTCCCTGTCTGCATCTGTAGGAGACCGTGTCACCAT<br>CACTTGCCGGGCAAACCAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 536) |
| ABT1-141-550 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATGAGCAGAAACCAGGGA<br>AAGCCCCTAAGCTCCTGATCTATTCCTCGTCCTGGTTGCAAAGTGGGATCCCATCACGTTTC<br>AGTGGCAGTGGATCTGGGACAGATTTCACTCTGACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 537) |
| ABT1-141-551 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 538) |
| ABT1-141-552 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATAGCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 539) |
| ABT1-141-553 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCGTCGTCCTGGTTGCAAAGTGGGCCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 540) |
| ABT1-141-554 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATAGCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 541) |
| ABT1-141-555 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCCTCGTCCCACTCGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 542) |
| ABT1-141-556 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 543) |

TABLE 64-continued

DNA sequences for ABT1 and ABT2 dAbs

| dAb Name | DNA sequence |
| --- | --- |
| ABT1-141-557 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATAGCTCGTCCTGGATGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 544) |
| ABT1-141-558 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATATGTCGTCCGAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 545) |
| ABT1-141-559 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCCTCGTCCTGGTCGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 546) |
| ABT1-141-561 | GACATCCAGATGACCCAGTCTCCATCCTCCCTGTCTGCATCTGTAGGAGACCGTGTCACCAT<br>CACTTGCCAGGCACACCAGTGGATTCAGAAGCAGTTAGCGTGGTATCAGCAGAAACCAGGGA<br>AAGCCCCTAAGCTCCTGATCTATTCCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 547) |
| ABT1-141-562 | GACATCCAGATGACCCAGTCTCCATCCTCCCTGTCTGCATCTGTAGGAGACCGTGTCACCAT<br>CACTTGCCGGGCAAACCAGTGGATTCAGAAGCAGTTAGCGTGGTATCAGCAGAAACCAGGGA<br>AAGCCCCTAAGCTCCTGATCTATAGCTCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 548) |
| ABT1-141-563 | GACATCCAGATGACCCAGTCTCCATCCTCCCTGTCTGCATCTGTAGGAGACCGTGTCACCAT<br>CACTTGCCGGGCAGACAGCTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGAGGATCTGGGACAGATTTCACTCTCACCATCAGCAGTCTGCAACCTGAAGATTT<br>TGCTTCGTACTACTGTCAACAGCATCTTCGTGTTCCTATGACGTTCGGCCAAGGGACCAAGG<br>TGGAAATCAAACGG (SEQ ID NO: 549) |
| ABT1-141-564 | GACATCCAGATGACCCAGTCTCCATCCTCCCTGTCTGCATCTGTAGGAGACCGTGTCACCAT<br>CACTTGCCGGAGCAACGAGTGGATTCAGAAGCAGTTAGCGTGGTATCAGCAGAAACCAGGGA<br>AAGCCCCTAAGCTCCTGATCTATTCTTCGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 550) |
| ABT1-141-565 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGATGCATCTCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 551) |
| ABT1-141-567 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTACTCTTCGAACCATCCCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 552) |
| ABT1-141-568 | GACATCCAGATGACCCAGTCTCCATCCTCCCTGTCTGCATCTGTAGGAGACCGTGTCACCAT<br>CACTTGCCGGGCAAGTCAGTGGATTCAGAAGCAGTTAGCGTGGTATCAGCAGAAACCAGGGA<br>AAGCCCCTAAGCTCCTGATCTATTCTTCGGGCCATCCCCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 553) |
| ABT1-141-569 | GACATCCAGATGACCCAGTCTCCATCCTCCCTGTCTGCATCTGTAGGAGACCGTGTCACCAT<br>CACTTGCCGGGCCAACCAGTGGATTCAGAAGCAGTTAGCGTGGTATCAGCAGAAACCAGGGA<br>AAGCCCCTAAGCTCCTGATCTATTCTTCGTCCCATCCCCAAAGTGGGGTCCCATCACGTTTC |

TABLE 64-continued

DNA sequences for ABT1 and ABT2 dAbs

| dAb Name | DNA sequence |
| --- | --- |
|  | AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 554) |
| ABT1-141-572 | GACATCCAGATGACCCAGTCTCCATCCTCCCTGTCTGCATCTGTAGGAGACCGTGTCACCAT<br>CACTTGCCGGAGCAACGAGTGGATTCAGAAGCAGTTAGCGTGGTATCAGCAGAAACCAGGGA<br>AAGCCCCTAAGCTCCTGATCTATTCTTCGTCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 555) |
| ABT1-141-573 | GACATCCAGATGACCCAGTCTCCATCCTCCCTGTCTGCATCTGTAGGAGACCGTGTCACCAT<br>CACTTGCCGGACCAACGAGTGGATTCAGAAGCAGTTAGCGTGGTATCAGCAGAAACCAGGGA<br>AAGCCCCTAAGCTCCTGATCTATTCTTCGGCCCATAGGCAAAGTGGGGTCCCATCACGTTTC<br>AGTGGCAGTGGATCTGGGACAGGTTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 556) |
| ABT1-141-574 | GACATCCAGATGACCCAGTCTCCATCCTCCCTGTCTGCATCTGTAGGAGACCGTGTCACCAT<br>CACTTGCCGGATCAACGAGTGGATTCAGAAGCAGTTAGCGTGGTATCAGCAGAAACCAGGGA<br>AAGCCCCTAAGCTCCTGATCTATTCTTCGACACATCCGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATCTTCGTGTTCCTATGACGTTCGGCCAAGGGACCAAGG<br>TGGAAATCAAACGG (SEQ ID NO: 557) |
| ABT1-142 | GACATCCAGATGACCCAGTCTCCATCCTCCCTGTCTGCATCTGTAGGAGACCGTGTCACCAT<br>CACTTGCCGGGCAAGTCAGTCGATTAATGATGTGTTAGCTTGGTACCAGCAGAAACCAGGGA<br>AAGCCCCTAGGCTCCTGATCTATTCGGCTTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTATATTAGTCTTCCTTTTACGTTCGGCCAAGGGACCAAGG<br>TGGAAATCAAACGG (SEQ ID NO: 558) |
| ABT1-143 | GACATCCAGATGACCCAGTCTCCATCCTCCCTGTCTGCATCTGTAGGAGACCGTGTCACCAT<br>CACTTGCCGGGCAAGTCAGAGGATTGATCGTCATTTATCTTGGTATCAGCAGAAACCAGGGA<br>AAGCCCCTAAGCTCCTGATCTATAAGACTTCCAAGTTGCAAAGTGGGGTCCCATCACGTTTC<br>AGTGGCAGTGGATCTGGGACAGATTTCACACTCACCATCAGCAGTCTGCAACCTGAAGATTT<br>TGCTACGTACTACTGTCAGCAGCTTCATGCTAAGCCTTTTACGTTCGGTCAAGGGACCAAGG<br>TGGAAATCAAACGG (SEQ ID NO: 559) |
| ABT1-144 | GACATCCAGATGACCCAGTCTCCATCCTCCCTGTCTGCATCTGTAGGAGACCGTGTCACTAT<br>CACTTGCCGGGCAAGTCAGCGGATTAAGAAGTATTTAGCTTGGTACCAGCAGAAACCAGGGA<br>AAGCCCCTAGGCTCCTGATCTATCGTTCTTCCCAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTCGTTTAAGAGGCCTGTTACGTTCGGCCAAGGGACCAAGG<br>TGGAAATCAAACGG (SEQ ID NO: 560) |
| ABT1-145 | GACATCCAGATGACCCAGTCTCCATCCTCCCTGTCTGCATCTGTAGGAGACCGTGTCACCAT<br>CACTTGCCGGGCAAGTCAGGATATTGATGATGGTTTAGCGTGGTATCAGCAGAAACCCGGGA<br>AAGCCCCTAAGCTCCTGATCTATCGTACGTCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACCGACTTGGCTGCCTCCTTGTACGTTCGGCCAAGGGACCAAGG<br>TGGAAATCAAACGG (SEQ ID NO: 561) |
| ABT1-146 | GACATCCAGATGACCCAGTCTCCATCCTCCCTGTCTGCATCTGTAGGAGACCGTGTCACCAT<br>CACTTGCCGGGCAAGTCAGAATATTAAGACGTTTTTACATTGGTATCAGCAGAAACCAGGGA<br>AAGCCCCTAAGCTCCTGATCTATCGTGTTTCCCATTTGCAAAGTGGGGTTCCATCACGTTTC<br>AGTGGCAGTGGATCTGGGACAGATTTCACTCTCACCATCAGCAGTCTGCAACCTGAAGATTT<br>TGCTACGTACTACTGTCAACAGGAGTATCGTATTCCTCTTACGTTCGGCCAAGGGACCAAGG<br>TGGAAATCAAACGG (SEQ ID NO: 562) |
| ABT1-148 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGCTCGTCTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTATCGTCATCCTTCTACGTTCGGCCAAGGGACCAAGG<br>TGGAAATCAAACGG (SEQ ID NO: 563) |
| ABT1-149 | GACATCCAGATGACCCAGTCTCCATCCTCTCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGTGGGCTGTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTGGCGGTGGCCTTCGACGTTCGGCCAAGGGACCAAGG<br>TGGAAATCAAGCGGGCGGCCGCAGAACAAAAACTCATCTCAGAAGAGGAT (SEQ ID NO: 564) |

TABLE 64-continued

DNA sequences for ABT1 and ABT2 dAbs

| dAb Name | DNA sequence |
| --- | --- |
| ABT1-150 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGTGTTTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTGGCCGTTGGCCTTCGACGTTCGGCCAAGGGACCAAGG<br>TGGAAATCAAACGGGCGGCCGCAGAACAAAAACTCATCTCAGAAGAGGAT (SEQ ID NO:<br>565) |
| ABT1-151 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGTCGTTCCGGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGGGCAGTGGTATCGGCATCCTGCGACGTTCGGCCAAGGGACCAAGG<br>TGGAAATCAAACGGGCGGCCGCAGAACAAAAACTCATCTCAGAAGAGGAT (SEQ ID<br>NO: 566) |
| ABT1-152 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGGAGGTCCGGTTTGCAAAGTGGGGTCCCATCACGTTTC<br>AGTGGCAGTGGATCTGGGACAGATTTCACTCTCACCATCGGCAGTCTGCAACCTGAAGATTT<br>TGCTACGTACTACTGCATGCAGTGGTATAGGGCGCCTAGTACGTTCGGCCAAGGGACCAAGG<br>TGGAAATCAAACGGGCGGCCGCAGAACAAAAACTCATCTCAGAAGAGGAT (SEQ ID NO:<br>567) |
| ABT1-153 | GACATCCAGATGACCCAGTCTCCATCCTCCCTGTCTGCATCTGTAGGAGACCGTGTCACCAT<br>CACTTGCCGGGCAAGTAGTCCTATTGTGGCTAATTTACGTTGGTACCAGCAGAAACCAGGGA<br>AAGCCCCTAAGCTCCTGATCTATGCTGCATCCAGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTACTCAGGGGTATGTGTGGCCTCCGACGTTCGGCCAAGGGACCAAGG<br>TGGAAATCAAACGGGCGGCCGCAGAACAAAAACTCATCTCAGAAGAGGAT (SEQ ID NO:<br>568) |
| ABT1-154 | GACATCCAGATGACCCAGTCTCCATCCTCCCTGTCTGCATCTGTAGGAGACCGTGTCACCAT<br>CACTTGCCGGGCAAGTACTGAGATTGTGCGTAATTTACGGTGGTACCAGCAGAAACCAGGGA<br>AAGCCCCTAAGCTCCTGATCTCGGGTGTTTCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGTTCAGGGTTATTCTTGGCCTGTTACGTTCGGCCAAGGGACCAAGG<br>TGGAAATCAAACGG (SEQ ID NO: 569) |
| ABT1-155 | GACATCCAGATGACCCAGTCTCCATCCTCCCTGTCTGCATCTGTAGGAGACCGTGTCACCAT<br>CACTTGCCGGGCAAGTAGTCCTATTGTGGCTAATTTACGTTGGTACCAGCAGAAACCAGGGA<br>AAGCCCCTAAGCTCCTGATCTATGCTGCATCCAGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTACTCAGGGGTATGTGTGGCCTCCGACGTTCGGCCAAGGGACCAAGG<br>TGGAAATCAAACGG (SEQ ID NO: 570) |
| ABT1-156 | GACATCCAGATGACCCAGTCTCCATCCTCCCTGTCTGCATCTGTAGGAGACCGTGTCACCAT<br>CACTTGCCGGGCAAGTTCGACTATTTTGGATAAGTTAGAGTGGTACCAGCAGAAACCAGGGA<br>AAGCCCCTAAGCTCCTGATCTCTGGTGCGTCCTGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCGGCAGGCGTTGTGGGATCCTCCGACGTTCGGCCAAGGGACCAAGG<br>TGGAAATCAAACGG (SEQ ID NO: 571) |
| ABT1-157 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGTGTGTCCGGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTCTCGGCCGCCTCGGACGTTCGGCCAAGGGACCAAGG<br>TGGAAATCAAACGG (SEQ ID NO: 572) |
| ABT1-158 | GACATCCAGATGACCCAGTCTCCATCCTCCCTGTCTGCATCTGTAGGAGACCGTGTCACCAT<br>CACTTGCCGGGCAAGTAGGTCTATTGGGCGTGGGTTAAATTGGTACCAGCAGAAACCAGGGA<br>AAGCCCCTAAGCTCCTGATCGGGGGTGGTCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGCTCAGGCGTCGCCGCTTCCGACGTTCGGCCAAGGGACCAAGGTGG<br>AAATCAAACGG (SEQ ID NO: 573) |
| ABT1-159 | GACATCCAGATGACCCAGTCTCCATCCTCCCTGTCTGCATCTGTAGGAGACCGTGTCACCAT<br>CACTTGCCGGGCAAGTAGTCCTATTGGTATGGATTTATTTTGGTACCAGCAGAAACCAGGGA<br>AAGCCCCTAGGCTCCTGATCGATGGTGTGTCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTTCTCAGCATTGGCCTGCGCCTCTGACGTTCGGCCAAGGGACCAAGG<br>TGGAAATCAAACGG (SEQ ID NO: 574) |

TABLE 64-continued

DNA sequences for ABT1 and ABT2 dAbs

| dAb Name | DNA sequence |
|---|---|
| ABT1-160 | GACATCCAGATGACCCAGTCTCCATCCTCCCTGTCTGCATCTGTAGGAGACCGTGTCACCAT<br>CACTTGTCGGGCAAGTACTGAGATTGTGCGTAATTTACGGTGGTACCAGCAGAAACCAGGGA<br>AAGCCCCTAATCTCCTGATCTGGGGGGGTTCCACTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGTTCAGGGTTATTCTTTGCCTGTTACGTTCGGCCAAGGGACCAAGG<br>TGGAAATCAAACGG (SEQ ID NO: 575) |
| ABT1-161 | GACATCCAGATGACCCAGTCTCCATCCTCCCTGTCTGCATCTGTAGGAGACCGTGTCACCAT<br>CACTTGCCGGGCAAGTCATGCTATTACTGGTAGTTTACGTTGGTACCAGCAGAAACCAGGGA<br>AAGCCCCTAAGCTCCTGATCAGTGGTGGGTCCGTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGCTCAGTGGTTGGGGGGGCCTATGACGTTCGGCCAAGGGACCAAGG<br>TGGAAATCAAACGG (SEQ ID NO: 576) |
| ABT1-162 | GACATCCAGATGACCCAGTCTCCATCCTCCCTGTCTGCATCTGTAGGAGGCCGCGTCACCAT<br>CACTTGCCGGGCAAGTCATTATATTAGGAATCGGTTACATTGGTACCAGCAGAAACCAGGGA<br>AAGCCCCTAAGCTCCTGATCGCGCGTGGGTCCGCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGTGCAGGATGGTTATCTGCCTCCTACGTTCGGCCAAGGGACCAAGG<br>TGGAAATCAAACGG (SEQ ID NO: 577) |
| ABT1-163 | GACATCCAGATGACCCAGTCTCCATCCTCCCTGTCTGCATCTGTAGGAGACCGTGTCACCAT<br>CACTTGCCGGGCAAGTGGGAATATTGTGCATAATTTACGTTGGTACCAGCAGAAACCAGGGA<br>AAGCCCCTAAGCTCCTGATCTATGCTGCATCCAGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGCGCAGGGGTATGAGTGGCCTCTTACGTTCGGCCAAGGGACCAAGG<br>TGGAAATCAAACAG (SEQ ID NO: 578) |
| ABT1-164 | GACATCCAGATGACCCAGTCTCCATCCTCCCTGTCTGCATCTGTAGGAGACCGTGTCACCAT<br>CACTTGCCGGGCAAGTCGTCCGATTGCTGGTAATTTACGGTGGTACCAGCAGAAACCAGGGA<br>AAGCCCCTAAGCTCCTGATCTGGGGGGCGTCCTCGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGTGCAGGGGTGGCAGTGGCCTATTACGTTCGGCCAAGGGACCAAGG<br>TGGAAATCAAACGG (SEQ ID NO: 579) |
| ABT1-165 | GACATCCAGATGACCCAGTCTCCATCCTCCCTGTCTGCATCTGTAGGAGACCGTGTCACCAT<br>CACTTGCCGGGCAAGTTCTTCGATTAGGGCGGGTTTAGCTTGGTACCAGCAGAAACCAGGGA<br>AAGCCCCTAAGCTCCTGATCGGGCCTGAGTCCGGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGGGCAGGGGATTGATGGTCCTGCTACGTTCGGCCAAGGGACCAAGG<br>TGGAAATCAAACGG (SEQ ID NO: 580) |
| ABT1-166 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGTGGTCTGTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGGTCAGTGGGCGCGTGCTCCTATGACGTTCGGCCAAGGGACCAAGG<br>TGGAAATCAAACGG (SEQ ID NO: 581) |
| ABT1-167 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGTGGGCTGTCCGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTGGCGGTATCCTCCTACGTTCGGCCAAGGGACCAAGG<br>TGGAAATCAAACGG (SEQ ID NO: 582) |
| ABT1-168 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGCTGTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCTGCAGTGGTTTTCTGAGCCTGCTACGTTCGGCCAAGGGACCAAGG<br>TGGAAATCAAACGG (SEQ ID NO: 583) |
| ABT1-169 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGTGGGTTGTCCGGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGGTGGCGGTGGCCTTCGACGTTCGGCCAAGGGACCAAGG<br>TGGAAATCAAACGG (SEQ ID NO: 584) |
| ABT1-170 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGTCGGTCCGGGTTGCAAAGTGGGGTCCCATCACGTTTC |

TABLE 64-continued

DNA sequences for ABT1 and ABT2 dAbs

| dAb Name | DNA sequence |
| --- | --- |
| | AGTGGCAGTGGATCTGGGACAGATTTCACTCTCACCATCAGCAGTCTGCAACCTGAAGATTT<br>TGCTACGTACTACTGTAAGCAGTGGTATAGGTATCCTTCTACGTTCGGCCAAGGGACCAAGG<br>TGGAAATCAAACGG (SEQ ID NO: 585) |
| ABT1-171 | GACATCCAGATGACCCAGTCTCCATCCTCCCTGTCTGCATCTGTAGGAGACCGTGTCACCAT<br>CACTTGCCGGGCAAGTCAGAGCATTAGCAGCTATTTAAATTGGTACCAGCAGAAACCAGGGA<br>AAGCCCCTAAGCTCCTGATCGGGGGCGGTCCGGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTATGCAGTGTTTCGTCCGCCTAGGACGTTCGGCCAAGGGACCAAGG<br>TGGAAATCAAACGG (SEQ ID NO: 586) |
| ABT1-172 | GACATCCAGATGACCCAGTCTCCATCCTCCCTGTCTGCATCTGTAGGAGACCGTGTCACCAT<br>CACTTGCCGGGCAAGTCAGCGTATTCGTAATGGTTTAGAGTGGTACCAGCAGAAACCAGGGA<br>AAGCCCCTAAGCTCCTGATCTGGGGTCGTCCCGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTGCGCAGACGGTTTGGGGTCCTGCGACGTTCGGCCAAGGGACCAAGG<br>TGGAAATCAAACGG (SEQ ID NO: 587) |
| ABT1-221 | GACATCCAGATGACCCAGTCTCCATCCTCCCTGTCTGCATCTGTAGGGGACCGTGTTACCAT<br>CACTTGCCGGGCAAGTCAGGATATTTGGCCTTATTTAATGTGGTATCAGCAGAAACCAGGGA<br>AAGCCCCTAAGCTCCTAATCTATTATTCTTCCATGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTAGGAGGTGGCCTTATACGTTCGGCCAAGGGACCPAGG<br>TGGAAATCAAACGG (SEQ ID NO: 588) |
| ABT2 VH dAbs | |
| ABT2-10 | GAGGTGCAGCTGTTGGAGTCTGGGGGAGGCTTGGTACAGCCTGGGGGGTCCCTGCGTCTCTC<br>CTGTACAGCCTCCGGATTCACCTTTAATAGGTATAATATGTGGTGGGCCCGCCAGGCTCCAG<br>GGAAGGGTCTAGAGTGGGTCTCAGAGATTGATCTTAAGGGTAGTCAGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGTGAGTATTAGTGCGT<br>ATCATATGTTTGACTACTGGGGTCAGGGAACCCTGGTCACCGTCTCGAGC (SEQ ID NO: 589) |
| ABT2-11 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATAATTATTCTATGACGTGGGTCCGCCAGGCTCCAG<br>GGAAGGGTCTGGAGTGGGTCTCAGCTATTAGTGGTAGTGGTGGTAGCACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAATGTATTGATCGTTTGC<br>CTTGTCTGTTTGACTACTGGGGTCAGGGAACCCTGGTCACCGTCTCGAGC (SEQ ID NO: 590) |
| ABT2-12 | GAGGTGCAGCTGTTGGAGTCTGGGGGAGGCTTGGTACAGCCTGGGGGGTCCCTGCGTCTCTC<br>CTGTGCAGCCTCCGGATTCACCTTTACGGGTTATGATATGGCTTGGGTCCGCCAGGCTCCAG<br>GGAAGGGTCTAGAGTGGGTCTCAGTGATTTATGCTTATGGTGAGTCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAATGACTTCTGCTTCTT<br>TTGACTACTGGGGTCAGGGAACCCTGGTCACCGTCTCGAGC (SEQ ID NO: 591) |
| ABT2-13 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCGGGATTATGTTATGTATTGGGCCCGCCAGGCTCCAG<br>GGAAGGGTCTAGAGTGGGTCTCAAGGATTGATCCTATGGGTAGTTCGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACCTGAGGGTAATTTTG<br>ACTACTGGGGTCAGGGAACCCTGGTCACCGTCTCGAGC (SEQ ID NO: 592) |
| ABT2-14 | GAGGTGCAGCTGTTGGAGTCTGGGGGAGGCCTGGTACAGCCTGGGGGGTCCCTGCGTCTCTC<br>CTGTGCAGCCTCCGGATTCACCTTTGCGGATTATGATATGTCTTGGGTCCGCCAGGCTCCAG<br>GGAAGGGTCTAGAGTGGGTCTCAACTATTTATGGTTTTGGTTTTGCGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACGTTGGCTGGGGGT<br>TTGACTACTGGGGTCAGGGAACCCTGGTCACCGTCTCGAGC (SEQ ID NO: 593) |
| ABT2-15 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAATGGCTAATGTAAGT<br>TTGACTACTGGGGTCAGGGAACCCTGGTCACCGTCTCGAGC (SEQ ID NO: 594) |
| ABT2-16 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGTGGGTCCGCCAGGCTCCAG<br>GGAAGGGTCTAGAGTGGGTCTCAGTTATTTATGCGTGGGGTACTAGTACATACTACGCAGAC |

TABLE 64-continued

DNA sequences for ABT1 and ABT2 dAbs

| dAb Name | DNA sequence |
|---|---|
| | TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAATAAGGGGCATGGGC<br>AGTTTGACTACTGGGGTCAGGGAACCCTGGTCACCGTCTCGAGC (SEQ ID NO: 595) |
| ABT2-17 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAATGAAGGGGAGTACTT<br>TTGACTACTGGGGTCAGGGAACCCTGGTCACCGTCTCGAGC (SEQ ID NO: 596) |
| ABT2-19 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACGTCTCCGGAGTCTT<br>TTGACTACTGGGGTCAGGGAACCCTGGTCACCGTCTCGAGC (SEQ ID NO: 597) |
| ABT2-20 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACTCCGCGGTATATTACTGTGCGAAACCTAGTATTGATGTT<br>TTGACTACTGGGGTCAGGGAACCCTGGTCACCGTCTCGAGC (SEQ ID NO: 598) |
| ABT2-21 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGTTAGTAGTGATACTT<br>TTGACTACTGGGGTCAGGGAACCCTGGTCACCGTCTCGAGC (SEQ ID NO: 599) |
| ABT2-22 | GAGGTGCAGCTGTTGGAGTCTGGGGGAGGCTTGGTACAGCCTGGGGGGTCCCTGCGTCTCTC<br>CTGTGCAGCCTCCGGATTCACCCTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGGCCTTTGTCTACGC<br>ATGATAGTTTTGACTACTGGGGTCAGGGAACCCTGGTCACCGTCTCGAGC (SEQ ID NO: 600) |
| ABT2-23 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTGTATTACTGTGCGAAAGGGAATTCGAGTTTGG<br>ATCCGAATTTTGACTACTGGGGTCAGGGAACCCTGGTCACCGTCTCGAGC (SEQ ID NO: 601) |
| ABT2-24 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGATACCGCGGTATATTACTGTGCGAAAACTCAGCCTAGGTCTC<br>TGGATAATTTTGACTACTGGGGTCAGGGAACCCTGGTCACCGTCTCGAGC (SEQ ID NO: 602) |
| ABT2-25 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTAAGTATAAGATGTCGTGGGTCCGCCAGGCTCCAG<br>GGAAGGGTCTAGAGTGGGTCTCAAGTATTAGTAGTTCTGGTTCTACTACATACTACGCAGAC<br>TCCGTGAAGGGCCGGTTCACCATCTCCCGCGACAATTCCAAGAACACGCTGTATCTGCAAAT<br>GGACAGCCTGCGTGCCGAGGACACCGCGGTATATTACTGTGCGAAACCTCTGTTGTTGGATG<br>TGGAGTTTGACTACTGGGGTCAGGGAACCCTGGTCACCGTCTCGAGC (SEQ ID NO: 603) |
| ABT2-26 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTAATTATAAGATGTCGTGGGTCCGCCAGGCTCCAG<br>GGAAGGGTCTAGAGTGGGTCTCAAGTATTAATACTTTCTGGTTCTACTACATACTACGCAGAC<br>TCCGTGAAGGGCCGGTTCACCATCTCCCGCGACAATTCCAAGAACACGCTGTATCTGCAAAT<br>GGACAGCCTGCGTGCCGAGGACACCGCGGTATATTACTGTGCGAAACCTCTGTTGTTGGATG<br>TGGAGTTTGACTACTGGGGTCAGGGAACCCTGGTCACCGTCTCGAGC (SEQ ID NO: 604) |
| ABT2-27 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCGCATTATTCGATGTGGTGGGTCCGCCAGGCTCCAG<br>GGAAGGGTCTAGAGTGGGTCTCACGTATTGGGTCTCCGGGTAATGATACATACTACGCAGAC<br>TCCGTGAAGGGCCGGTTCACCATCTCCCGCGACAATTCCAAGAACACGCTGTATCTGCAAAT |

TABLE 64-continued

DNA sequences for ABT1 and ABT2 dAbs

| dAb Name | DNA sequence |
| --- | --- |
| | GAACAGCCTGCGTGCCGAGGACACCGCGGTATATTACTGTGCGAAATTTGGGTTTAGGTCTG<br>CGGAGTCTTTTGACTACTGGGGTCAGGGAACCCTGGTCACCGTCTCGAGC (SEQ ID<br>NO: 605) |
| ABT2-28 | GAGGTGCAGCTGTTGGAGTCTGGGGGAGGCTTGGTACAGCCTGGGGGGTCCCTGCGTCTCTC<br>CTGTGCAGCCTCCGGATTCACCTTTACGGGTTATGATATGGCTTGGGTCCGCCAGGCTCCAG<br>GGAAGGGTCTAGAGTGGGTCTCAGTGATTTATGCTTATGGTGAGTCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAACCTGTGCAGGGGTCGT<br>TGTTGGGGTTTGACTACTGGGGTCAGGGAACCCTGGTCACCGTCTCGAGC (SEQ ID<br>NO: 606) |
| ABT2-29 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGCGACGTTTGGGAATC<br>TGGAGGAGTCGTTTGACTACTGGGGTCAGGGAACCCTGGTCACCGTCTCGAGC (SEQ ID<br>NO: 607) |
| ABT2-30 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATTCGGCTGGGCCTT<br>TTGGGCAGACGCTGTTTGACTACTGGGGTCAGGGAACCCTGGTCACCGTCTCGAGC (SEQ<br>ID NO: 608) |
| ABT2-31 | GAGGTGCAGCTGTTGGAGTCTGGGGGAGGCTTGGTACAGCCTGGGGGGTCCCTGCGTCTCTC<br>CTGTGCAGCCTCCGGATTCACCTTTACGGGTTATGATATGGCTTGGGTCCGCCAGGCTCCAG<br>GGAAGGGTCTAGAGTGGGTCTCAGTGATTTATGCTTATGGTGAGTCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAAAGAGTAAGGGGCCTT<br>CTGGTCTTCGTACGTTTGACTACTGGGGTCAGGGAACCCTGGTCACCGTCTCGAGC (SEQ<br>ID NO: 609) |
| ABT2-32 | GAGGTGCAGCTGTTGGAGTCTGGGGGAGGCTTGGTACAGCCTGGGGGGTCCCTGCGTCTCTC<br>CTGTGCAGCCTCCGGATTCACCTTTACGGGTTATGATATGCTTGGGTCCGCCAGGCTCCAG<br>GGAAGGGTCTAGAGTGGGTCTCAGTGATTTATGCTTATGGTGAGTCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACTACGCCGAAGTCTA<br>ATCTGCGTGATTTTGACTACTGGGGTCAGGGAACCCTGGTCACCGTCTCGAGC (SEQ ID<br>NO: 610) |
| ABT2-33 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATGCTATGCTTGGGCCGCCAGGCTCCAG<br>GGAAGGGTCTAGAGTGGGTCTCATCTATTTTGGCGGATGGTCATTCGACACACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACCTTATGCGGCGGTTT<br>TTAATCGTGTGTATTTTGACTACTGGGGTCAGGGAACCCTGGTCACCGTCTCGAGC (SEQ<br>ID NO: 611) |
| ABT2-35 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGTGAGTATGATATGGCTTGGGTCCGCCAGGCTCCAG<br>GGAAGGGTCTAGAATGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAATGGGTGGTGGGCTTG<br>TTTCTCTTCCTCAGTCTAAGTTTGACTACTGGGGTCAGGGAACCCTGGTCACCGTCTCGAGC<br>(SEQ ID NO: 612) |
| ABT2-36 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCAGTCGTATGATATGTTTGGGTCCGCCAGGCTCCAG<br>GGAAGGGTCTAGAGTGGGTCTCATGTATTTATGCTTATGGTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACCTGCTGTTGGTACGC<br>ATCGTCAGCGGGCTGTTTTTGACTACTGGGGTCAGGGAACCCTGGTCACCGTCTCGAGC<br>(SEQ ID NO: 613) |
| ABT2-37 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTCGGTATTCGATGATGTGGGTCCGCCAGGCTCCAG<br>GGAAGGGTCTAGAGTGGGTCTCAGGGATTGATTCTACGGGTGTTCATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAGGTAGTTATGCTCTTT<br>GGGGTCGTGAGCCGACTTTTGACTACTGGGGTCAGGGAACCCTGGTCACCGTCTCGAGC<br>(SEQ ID NO: 614) |

TABLE 64-continued

DNA sequences for ABT1 and ABT2 dAbs

| dAb Name | DNA sequence |
| --- | --- |
| ABT2-38 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATCGGTATGCGATGGGGTGGGTCCGCCAGGTTCCAG<br>GGAAGGGTCTAGAGTGGGTCTCAACGATTAATGTTCCGGGTACGTTTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAGGGCATTTTCCGCGTG<br>GTGGGGCGATTGTTCCTTTTGACTACTGGGGTCAGGGAACCCTGGTCACCGTCTCGAGC<br>(SEQ ID NO: 615) |
| ABT2-39 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAATTGATCGGGATGCGA<br>GTCTGCCGACGGGGGAGGGGTTTGACTACTGGGGTCAGGGAACCCTGGTCACCGTCTCGAGC<br>(SEQ ID NO: 616) |
| ABT2-40 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAACCGTGTGCGATTTGTG<br>ATACGGATTCGTTGGGTTTTGACTACTGGGGTCAGGGAACCCTGGTCACCGTCTCGAGC<br>(SEQ ID NO: 617) |
| ABT2-41 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCTTATGATATGGGGTGGGTCCGCCAGGCTCCAG<br>GGAAGGGTCTAGAGTGGGTCTCAGTTATTTATGCGTGGGGTACTAGTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACTACTGATATTAATA<br>AGAGGTGGCCTACTGGGTTTGACTACTGGGGTCAGGGAACCCTGGTCACCGTCTCGAGC<br>(SEQ ID NO: 618) |
| ABT2-64 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATGATTATGGGATGGGTTGGGTCCGCCAGGCTCCAG<br>GGAAGGGTCTTGAGTGGGTCTCACTTATTTATCCGTTTGGTGGGGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAGTTACGCAGACTGGTA<br>AGTTTGACTACTGGGGTCAGGGAACCCTGGTCACCGTCTCGAGC (SEQ ID NO: 619) |
| ABT2-65 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 620) |
| ABT2-65-1 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAAGAGCCTGCTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 621) |
| ABT2-65-2 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTCTACTTATAATATGGGTTGGGTCCGCCAGGCTCCAG<br>GGAAGGGTCTAGAGTGGGTCTCATCGATTTCGGCTATGGGTAATCGGACATACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAATAATCTGGTTCGTACTC<br>AGTCTAAGATGTGGATGTTTGACTACTGGGGTCAGGGAACCCTGGTCACCGTCTCGAGC<br>(SEQ ID NO: 622) |
| ABT2-65-6 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 623) |
| ABT2-65-7 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTACGGGTAATCGGACATACTACGCAGAC |

TABLE 64-continued

DNA sequences for ABT1 and ABT2 dAbs

| dAb Name | DNA sequence |
|---|---|
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGACGA<br>GGATTAAGATGTGGATGTTTGACTACTGGGGTCAGGGAACCCTGGTCACCGTCTCGAGC<br>(SEQ ID NO: 624) |
| ABT2-65-8 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTTTATTACTGTGCGCAAAATCTGGTTCGTATGG<br>ATAGTAGGCGTTGGATGTTTGACTACTGGGGTCAGGGAACCCTGGTCACCGTCTCGAGC<br>(SEQ ID NO: 625) |
| ABT2-65-9 | GAGGTGCAGCTGTTGGAGTCTGGGGGAGGCTTGGTACATCCTGGGGGGTCCCTGCGTCTCTC<br>CTGTGCAGCCTCCGGATTCACCTTTCGTTGGTATCCGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTACTC<br>AGTCTAAGATGTGGATGTTTGACTACTGGGGTCAGGGAACCCTGGTCACCGTCTCGAGC<br>(SEQ ID NO: 626) |
| ABT2-65-10 | AGGTGCAGCTGTCGGAGTCTGGGGGAGGCTTGGTACAGCCTGGGGGGTCCCTGCGTCTCTCC<br>TGTGCAGCCTCTGGATTCACCTTTACGGAGTATAATATGGGTTGGGTCCGCCAGGCTCCAGG<br>GAAGGGTCTAGAGTGGGTCTCATCGATTTCGGCTATGGGTAATCGGACATACTACGCAGACT<br>CCGTGAAGGGCCGGTTCACCATCTCCCGCGACGATTCCAAGAACACGCTGTATCTGCAAATG<br>AACAGCCTGCGTGCCGAGGACACCGCGGTATATTACTGTGCGAATAATCTGGTTCGTACTCA<br>GTCTAAGATGTGGATGTTTGACTGGGGTCAGGGAACCCTGGTCACCGTCTCGAGC<br>(SEQ ID NO: 627) |
| ABT2-65-11 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGCGTATCCTATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAATAATCTGGTTCGTACTC<br>AGTCTAAGATGTGGATGTTTGACTACTGGGGTCAGGGAACCCTGGTCACCGTCTCGAGC<br>(SEQ ID NO: 628) |
| ABT2-65-12 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCGGGAGTATTGGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAACAATCTGGTTCGTACTC<br>AGTCTAAGATGTGGATGTTTGACTACTGGGGTCAGGGAACCCTGGTCACCGTCTCGAGC<br>(SEQ ID NO: 629) |
| ABT2-65-13 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGAGTATCAGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAATAATCTGGTTCGTACTC<br>AGTCTAAGATGTGGATGTTTGACTACTGGGGTCAGGGAACCCTGGTCACCGTCTCGAGC<br>(SEQ ID NO: 630) |
| ABT2-65-14 | GAGGTGCAGCTGTTGGAGTCCGGGGGAGGCTTGGTACAGCCTGGGGGGTCCCTGCGTCTCTC<br>CTGTGCAGCCCCCGGATTCACCTTTCCGTATTATCCGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 631) |
| ABT2-65-15 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGTATTTATCAGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 632) |
| ABT2-65-16 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGTGGA<br>GGAGTGCGGAGTGGATGTTTGACTACTGGGGTCAGGGAACCCTGGTCACCGTCTCGAGC<br>(SEQ ID NO: 633) |

TABLE 64-continued

DNA sequences for ABT1 and ABT2 dAbs

| dAb Name | DNA sequence |
| --- | --- |
| ABT2-65-17 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 634 |
| ABT2-65-18 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGGGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCAGTGGA<br>GGATTGGTGCGTGGATGTTTGACTACTGGGGTCAGGGAACCCTGGTCACCGTCTCGAGC<br>(SEQ ID NO: 635) |
| ABT2-65-19 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCAAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTTTTTATG<br>ATGCGATGAGGTGGATGTTTGACTACTGGGGTCAGGGAACCCTGGTCACCGTCTCGAGC<br>(SEQ ID NO: 636) |
| ABT2-65-20 | GAGGCGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCAGTTATTAGTCAGTTGGGTTGGAATACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 637) |
| ABT2-65-21 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCAGCTATTTCGCAGCTGGGTTGGCATACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 638) |
| ABT2-65-22 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCTTGGGTATCCGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCTCCCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 639) |
| ABT2-65-23 | GAGGTGCAGCTGTTGGAGTCTGGGGGAGGCTTGGTACAGCCTGGGGAGTCCCTGCGTCTCTC<br>CTGTGCAGCCTCCGGATTCACCTTTAAGGTGTATCCTATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 640) |
| ABT2-65-24 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCGGCTTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 641) |
| ABT2-65-25 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTTATC<br>GTAGTTATTATTGGATGTTTGACTACTGGGGTCAGGGAACCCTGGTCACCGTCTTGAGC<br>(SEQ ID NO: 642) |
| ABT2-65-26 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCTGGTGC<br>GTTCGGGTTATTGGATGTTTGACTACTGGGGTCAGGGAACCCTGGTCACCGTCTCGAGC<br>(SEQ ID NO: 643) |
| ABT2-65-27 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTCTGT<br>GGAAGGGTAGGTGGATGTTTGACTACTGGGGTCAGGGAACCCTGGTCACCGTCTCGAGC<br>(SEQ ID NO: 644) |
| ABT2-65-28 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCAGTTTC<br>GTCGTTCTCAGTGGATGTTTGATTACTGGGGTCAGGGAACCCTGGTCACCGTCTCGAGC<br>(SEQ ID NO: 645) |
| ABT2-65-29 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTTTGGTTC<br>GGGTTGGGTGGTGGATGTTTGACTACTGGGGTCAGGGAACCCTGGTCACCGTCTCGAGC<br>(SEQ ID NO: 646) |
| ABT2-65-30 | GAGGTGCGGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTCTGA<br>ATAGGAGGGATTGGATGTTTGACTACTGGGGTCAGGGAACCCTGGTCACCGTCTCGAGC<br>(SEQ ID NO: 647) |
| ABT2-65-31 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAAGATTA<br>TGAGGTTGAAGTGGATGTTTGACTACTGGGGTCAGGGAACCCTGGTCACCGTCTCGAGC<br>(SEQ ID NO: 648) |
| ABT2-65-32 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTGCGGTGT<br>CGCGGGGTCGGTGGATGTTTGACTACTGGGGTCAGGGAACCCTGGTCACCGTCTCGAGC<br>(SEQ ID NO: 649) |
| ABT2-65-33 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGTATA<br>TGAAGTCTCAGTGGATGTTTGACTACTGGGGTCAGGGAACCCTGGTCACCGTCTCGAGC<br>(SEQ ID NO: 650) |
| ABT2-65-34 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTA<br>GGTCTAAGAGGTGGATGTTTGACTACTGGGGTCAGGGAACCCTGGTCACCGTCTCGAGC<br>(SEQ ID NO: 651) |
| ABT2-65-35 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGA<br>GGAGGTCTAGGTGGATGTTTGACTACTGGGGTCAGGGAACCCTGGTCACAGTCTCGAGC<br>(SEQ ID NO: 652) |

TABLE 64-continued

DNA sequences for ABT1 and ABT2 dAbs

| dAb Name | DNA sequence |
|---|---|
| ABT2-65-36 | GAGGTGCGGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 653) |
| ABT2-65-37 | GAGGTGCAGCTGTTGGAGTCTGGGGGAGGCTTAGTACAGCCTGGGGGGTCCCTGCGTCTCTC<br>CTGTGCAGCCTCCGGATTCACCTTTGCGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 654) |
| ABT2-65-38 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTACCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 655) |
| ABT2-65-39 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGGAAATCTGGTTCGTACTC<br>AGTCTAAGATGTGGATGTTTGACTACTGGGGTCAGGGAACCCTGGTCACCGTCTCGAGC<br>(SEQ ID NO: 656) |
| ABT2-65-40 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAAGACGT<br>TTAAGAGTAGGTGGATGTTTGACTACTGGGGTCAGGGAACCCTGGTCACCGTCTCGAGC<br>(SEQ ID NO: 657) |
| ABT2-65-41 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGGTGACTCGTACTC<br>AGTCTAAGCTGGGGCTGTTTGACTACTGGGGTCAGGGAACCCTGGTCACCGTCTCGAGC<br>(SEQ ID NO: 658) |
| ABT2-65-42 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGGTGACTCGTACTC<br>AGTCTAAGTTGGGTCGGTTTGACTACTGGGGTCAGGGAACCCTGGTCACCGTCTCGAGC<br>(SEQ ID NO: 659) |
| ABT2-65-43 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGAGGTATCGTATTC<br>AGTCTAAGCTGGGGCTGTTTGACTACTGGGGTCAGGGAACCCTGGTCACCGTCTCGAGC<br>(SEQ ID NO: 660) |
| ABT2-65-44 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGTGGGTCGTATTC<br>AGTCTAAGTTGGGTCTGTTTGACTACTGGGGTCAGGGAACCCTGGTCACCGTCTCGAGC<br>(SEQ ID NO: 661) |
| ABT2-65-45 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGCGTCGGCGTACTC<br>AGTCTAAGCTGGGGTATTTTGACTACTGGGGTCAGGGAACCCTGGTCACCGTCTCGAGC<br>(SEQ ID NO: 662) |
| ABT2-65-<br>46 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTTTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGTTGACGCGTACTC<br>AGTCTAAGTTGGGGTATTTTGACTACTGGGGTCAAGGAACCCTGGTCACCGTCTCGAGC<br>(SEQ ID NO: 663) |
| ABT2-65-<br>47 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGAGGAAGCGTACTC<br>AGTCTAAGCTTGGTTATTTTGACTACTGGGGTCAGGGAACCCTGGTCACCGTCTCGAGC<br>(SEQ ID NO: 664) |
| ABT2-65-<br>48 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAATGGCAGATGCGTACTC<br>AGTCTAAGCTTGGTTATTTTGACTACTGGGGTCAGGGAACCCTGGTCACCGTCTCGAGC<br>(SEQ ID NO: 665) |
| ABT2-65-<br>49 | GGGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 666) |
| ABT2-65-<br>50 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCTGACGTATCCGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCGGGGAACCCTGGTCACCGTCTCGAGC<br>(SEQ ID NO: 667) |
| ABT2-65-<br>52 | GAGGTGCAGGTGTTGGAGTCTGGGGGAGGCTTGGTACAGCCTGGGGGGTCCCTGCGTCTCTC<br>CTGTGCAGCCTCCGGATTCACCTTTTATAGTTATCCTATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 668) |
| ABT2-65-<br>53 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTATGTTTATCCTATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCTGAGGACACCGCGGTATATTACTGTGCGATAAATCTGGTTCGTACTC<br>AGTCTAAGATGTGGATGTTTGACTACTGGGGTCAGGGAACCCTGGTCACCGTCTCGAGC<br>(SEQ ID NO: 669) |
| ABT2-65-<br>54 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCAACTATTAGTCAGTTGGGTTGGATGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGAAAAATCTGGTTCGTACTC<br>AGTCTAAGATGTGGATGTTTGACTACTGGGGTCAGGGAACCCTGGTCACCGTCTCGAGC<br>(SEQ ID NO: 670) |
| ABT2-65-<br>55 | GAGGTGCAGCTGTTGGAGTCTGGGGGAGGCTTGGCACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCAGCGATTACTCAGCTTGGTTGGTATACATACTACGCAGAC<br>TCCGTGAAGGGCCGGTTCACCATCTCCCGCGACGATTCCAAGAACACGCTGTATCTGCAAAT<br>GAACAGCCTGCGTGCTGAGGACACCGCGGTATATTACTGTGCGAAAAATCTGGTTCGTACTC<br>AGTCTAAGATGTGGATGTATGACTACTGGGGTCAGGGAACCCTGGTCACCGTCTCGAGC<br>(SEQ ID NO: 671) |

TABLE 64-continued

DNA sequences for ABT1 and ABT2 dAbs

| dAb Name | DNA sequence |
|---|---|
| ABT2-65-56 | GAGGTGCAGTTGTTGGAGTCTGGGGGAGGCTTGGTACAGCCTGGGGGGTCCCTGCGTCTCTC<br>CTGTGCAGCCTCCGGATTCACCTTTCCTGAGTATTATATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 672) |
| ABT2-65-57 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGAGTATGGTATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 673) |
| ABT2-65-58 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGTTATTTATCCGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 674) |
| ABT2-65-59 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATACTTATTGGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 675) |
| ABT2-65-60 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGTATGTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 676) |
| ABT2-65-61 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGAGTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 677) |
| ABT2-65-62 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCGGGAGTATTTTATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 678) |
| ABT2-65-63 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGATGGTTATAATATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC (SEQ ID NO: 679) |
| ABT2-65-64 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCAAGTATTAGGACTCCTGGTAAGTTTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 680) |
| ABT2-65-65 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCTATTAGTGTGGCTGGTAAGCCTACATACTACGCAGAC |

TABLE 64-continued

DNA sequences for ABT1 and ABT2 dAbs

| dAb Name | DNA sequence |
|---|---|
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 681) |
| ABT2-65-<br>66 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCAACTATTGCGCTGCTGGGTGGGCCTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 682) |
| ABT2-65-<br>67 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCAACGATTCAGGTTTTTGGTGGTAAGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 683) |
| ABT2-65-<br>68 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCAAGTATTCGGCCGACTGGTCCGTTTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 684) |
| ABT2-65-<br>69 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCTATTTATAGTCGTGGTACGCCTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 685) |
| ABT2-65-<br>70 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTCCGAGGGTGGGTATGCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 686) |
| ABT2-65-<br>71 | GAGGTGCAGCTGTTGGAGTCTGGGGGAGGCTTGGTACAGCCTGGGGGGTCCCTGCGTCTCTC<br>CTGTATAGCCTCCGGATTCACCTTTGAGGATTATCAGATGGGGTGGGTCCGCCAGGCTCCAG<br>GGAAGGGTCTAGAGTGGGTCTCAGCTATTCGGAATGTTGGTAGGGCTACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 687) |
| ABT2-65-<br>72 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCAGTGATTGGTTTTCCTGGTAGGCTGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 688) |
| ABT2-65-<br>73 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTCGGCGGTTGGTGTTGGTACATACTACGCAGAC<br>TCCGTGAAGGGCCGGTTCACCATCTCCCGCGACGATTCCAAGGACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 689) |
| ABT2-65-<br>74 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCAGCATTATTATATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGTACTC<br>AGTCTAAGATGTGGATGTTTGACTACTGGGGTCAGGGAACCCTGGTCACCGTCTCGAGC<br>(SEQ ID NO: 690) |

TABLE 64-continued

DNA sequences for ABT1 and ABT2 dAbs

| dAb Name | DNA sequence |
|---|---|
| ABT2-65-75 | GAGGTGCAGCTGTTGGAGTCTGGGGGAGGCTTGGTACAGCATGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAAGTCTAGGTGGATGTTTGACTACTGGGGTCAGGGAACCCTGGTCACAGTCTCGAGC<br>(SEQ ID NO: 691) |
| ABT2-65-76 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCGG<br>GGAAGGGTCTAGAGTGGGTCACATCGATTTCGGCTATGGGTAATCGGACATACTACGCAGAC<br>TCCGTGAAGGGCCGGTTCACCATCTCCCGCGACGATTCCAAGAACACGCTGTACCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 692) |
| ABT2-65-77 | GAGGTGCAGCTGTTGGAGTCTGGGGGAGGCTTGGTACAGCATGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCTTGGTCACTGTCTCGAGC<br>(SEQ ID NO: 693) |
| ABT2-65-75 | GAGGTGCAGCTGTTGGAGTCTGGGGGAGGCTTGGTACAGCATGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAAGTCTAGGTGGATGTTTGACTACTGGGGTCAGGGAACCCTGGTCACAGTCTCGAGC<br>(SEQ ID NO: 691) |
| ABT2-65-76 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCGG<br>GGAAGGGTCTAGAGTGGGTCACATCGATTTCGGCTATGGGTAATCGGACATACTACGCAGAC<br>TCCGTGAAGGGCCGGTTCACCATCTCCCGCGACGATTCCAAGAACACGCTGTACCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 692) |
| ABT2-65-77 | GAGGTGCAGCTGTTGGAGTCTGGGGGAGGCTTGGTACAGCATGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCTTGGTCACTGTCTCGAGC<br>(SEQ ID NO: 693) |
| ABT2-65-78 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGACGTCTAGGTGGATGTTTGACTACTGGGGTCAGGGAGCCCTGGTCACAGTCTCGAGC<br>(SEQ ID NO: 694) |
| ABT2-65-79 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGGGGACACCGCGGTATATTACTGTGCGCAAAATCTGGTTAGGCTGG<br>GGAGGTCTAGGTGGATGTTTGACTACTGGGGTCAGGGAACCATGGTCACAGTCTCGAGC<br>(SEQ ID NO: 695) |
| ABT2-65-80 | GAGGTGCAGCTGTTGGAGTCTGGGGAGGCTTGGTACAGCCTGGGGGGTCCCTGCGTCTCGC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGTCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 696) |
| ABT2-65-81 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGAATATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACTATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 697) |
| ABT2-65-82 | GAGGTGCAGCTGTTGGAGTCTGGGGGAGGCTTGGTACGGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATCCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 698) |
| ABT2-65-83 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCAGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 699) |
| ABT2-65-84 | GAGGTGCAGCTGTTGGAGTCTGGGGGAGGCTTGGTACAGCCTGGGGGGTCCCTGCGTCTCTC<br>CTGTGTAGCCTCCGGATTCTCCTTTGAGGATTATCAGATGGGGTGGGTCCGCCAGGCTCCAC<br>GGAAGGGTCTAGAGTGGATCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 700) |
| ABT2-65-85 | GAGGTGCAGCTGATGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAACCGGACATACTACGCAGAC<br>TCCGTGAAGGGCCGGTTCGCCATCTCCCGCGACGATTCCAAGAACACGCTGTATCTGCAAAT<br>GAACAGCCTGCGTGCCAAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 701) |
| ABT2-65-86 | GAGGTGCAGCTGTTGGAGTCTGGGGGAGGCTTGGTACGGCCTGGGGGGTCCCAGCGTCTCTC<br>CTGTGTAGCCTCCGGATTCACCTCTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 702) |
| ABT2-65-87 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGATCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 703) |
| ABT2-65-88 | GAGGTGCAGTTGTTGGAGTCTGGGGGAGGCTTGGTACAGCCTGGGGGGTCCCTGCGTCTCTA<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACAATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 704) |
| ABT2-65-89 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGAGCCGAGGACACCGCGGTATATTACTGTGCGCAAAATATGGTTAGGCTGG<br>GGAGGTCTAGGTGGATGTTTGACTACTGGGGTCAGGGAACCCTGGTCACAGTCTCGAGC<br>(SEQ ID NO: 705) |
| ABT2-65-90 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCAAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCACGGAACCCTGGTCACAGTCTCGAGC<br>(SEQ ID NO: 706) |

TABLE 64-continued

DNA sequences for ABT1 and ABT2 dAbs

| dAb Name | DNA sequence |
| --- | --- |
| ABT2-65-113 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGTGCAGTATCAGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 707) |
| ABT2-65-114 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGGGAGTATATGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 708) |
| ABT2-65-115 | GAGGTGCAGCTGTTGGAGTCTGGGGGAGGCTTGGTACAGCCTGGGGGGTCCCTGCGTCTCTC<br>CTGTGCAGCCTCCGGATTCACCTTTATTGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 709) |
| ABT2-65-116 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCGGGTTATTATATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 710) |
| ABT2-65-117 | GAGGTGCAGCTGTTGGAGTCTGGGGGAGGCTTGGTACGGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGATCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 711) |
| ABT2-65-118 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCGACTTATACGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 712) |
| ABT2-65-119 | GAGGTGCAGCTGTTGGAGTCTGGGGGAGGCTTGGTACAGCCTGGGGGGTCCCTGCGTCTCTC<br>CTGTGCAGCCTCCGGATTCACCTTTATTGCGTATCCGATGGGTTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC (SEQ ID NO: 713) |
| ABT2-65-120 | GAGGTGCAGCTGTTGGAGTCTGGGGGAGGCCTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCTGCTATGGGTATGCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 714) |
| ABT2-65-121 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGTTGGGTCCGCCAGGCTCCAG<br>GGAAGGGTCTAGAGTGGGTCTCATCTATTGCGGCTCATGGTAATAGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 715) |
| ABT2-65-122 | GAGGTGCAGCTGTTGGAGTCTGGGGGAGGCTTGGTACGGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
|---|---|
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 716) |
| ABT2-65-123 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGAGATACTACGCAGAC<br>TCCGTGAAGGGCCGGTTCACCATCTCCCGCGACAATTCCAAGAACACGCTGTATCTGCAAAT<br>GAACATCCTGCGTGCCGAGGACACCGCGGTATATTACTGTGCGCAAAATCTGGTTAGGCTGG<br>GGAGGTCTAGGTGGGTGTTTGACTACTGGGGTCAGGGAACCCTGGTCACAGTCTCGAGC<br>(SEQ ID NO: 717) |
| ABT2-65-124 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTGTGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACATCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 718) |
| ABT2-65-125 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGATCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 719) |
| ABT2-65-126 | GAGGTGCAGCTGTTGGAGTCTGGGGGAGGCTTGGTACAGCCTGGGGGGTCCCTGCGTATCTC<br>CTGTGTAACCTCCGGGTTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGAATCTGCAAAT<br>GAACAGCCTGCGTGCCGAGGACACCGCGGTATATTACTGTGCGCAAAATCTGGTTAGGCTGG<br>GGAGGTCTAGGTGGGTGTTTGACTACTGGGGTCAGGGAACCCTGGTCACAGTCTCGAGC<br>(SEQ ID NO: 720) |
| ABT2-65-127 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCACATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 721) |
| ABT2-65-128 | GAGGTGCAGCTGTTGGAGTCTGGGAGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGATATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 722) |
| ABT2-65-129 | GAGGTGCAGCTGTTGGAGTCTGGGGGAGGCTTGGTACAGCCTGGGGGGTCCCTGCGTCTCTC<br>CTGTGTAGCCTCCGGTTTCACCTTTGAGGATTATCAGATGGGGTGGGTCCGCCAGGCTCCAG<br>GGAAGGGTCTAGAGTGGGTCTCAACGGTTTCGGCTATGGGTAATCGGACATACTACGCAGAC<br>TCCATGAAGGGCCGGTTCACCATCTCTCGCGACGATTCCAAGAACACGCTGTATCTGCAAAT<br>GAACAGCCTGCGTGCAGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 723) |
| ABT2-65-130 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGTTAATCGGACATACTACGCAGAC<br>TCCGTGAAGGGCAGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 724) |
| ABT2-65-131 | GAGGTGCAGCTGTTGGAGTCTGGGGGAGGCTTGGTACAGCCTCGGGGGTCCCTGCGTCTCTC<br>CTGTGTAGCCTCCGGATTCACCTTTGAGGATTATCAGATGGGGTCCGCCAGGCTCCAG<br>GCAAGGGTCTAGAGTGGGTCTCATCGATTTCGACTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCAGAGGACACCGCGGTATATCACTGTGCGCAAAATCTGGTTAGGTTGG<br>GGAGGTCTAGGTGGATGTTTGACTACTGGGGTCAGGGAACCCTGGTCACAGTCTCGAGC<br>(SEQ ID NO: 725) |

TABLE 64-continued

DNA sequences for ABT1 and ABT2 dAbs

| dAb Name | DNA sequence |
|---|---|
| ABT2-65-132 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTCTTG<br>CTTCGAGGAGGTGGATGTTTGACTACTGGGGTCAGGGAACCCTGGTCACCGTCTCGAGC<br>(SEQ ID NO: 726) |
| ABT2-65-133 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACGATCTCCCGCGACGATTCCAAGAACACGCTGTATCTGCAAAT<br>GAACAGCCTGCGTGCCGAGGACACCGCGGTATATTACTGTGCGGAAAATCTGGTTCATTGGA<br>AGAGGGGGGTTGGATGTTTGACTACTGGGGTCAGGGAACCCTGGTCACCGTCTCGAGC<br>(SEQ ID NO: 727) |
| ABT2-65-134 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGTTGT<br>CTAAGAGTCGTTGGATGTTTGACTACTGGGGTCAGGGAACCCTGGTCACCGTCTCGAGC<br>(SEQ ID NO: 728) |
| ABT2-65-135 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGATTA<br>AGAAGATGAAGTGGATGTTTGACTACTGGGGTCAGGGAACCCTGGTCACCGTCTCGAGC<br>(SEQ ID NO: 729) |
| ABT2-65-136 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGCTGT<br>CGCGTACTGAGTGGATGTTTGACTACTGGGGTCAGGGAACCCTGGTCACCGTCTCGAGC<br>(SEQ ID NO: 730) |
| ABT2-65-137 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTTACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGGACGG<br>CTAAGCGTAGGTGGATGTTTGACTACTGGGGTCAGGGAACCCTGGTCACCGTCTCGAGC<br>(SEQ ID NO: 731) |
| ABT2-65-138 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGGGTTA<br>CGGCGCGGAAGTGGATGTTTGACTACTGGGGTCAGGGAACCCTGGTCACCGTCTCGAGC (SEQ ID NO: 732) |
| ABT2-65-139 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGGTGC<br>GTGTGCGTCGGTGGATGTTTGACTACTGGGGTCAGGGAACCCTGGTCACCGTCTCGAGC<br>(SEQ ID NO: 733) |
| ABT2-65-140 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGATTT<br>CGAGGCGTCATTGGATGTTTGACTACTGGGGTCAGGGAACCCTGGTCACCGTCTCGAGC<br>(SEQ ID NO: 734) |
| ABT2-65-141 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGATTA<br>AGCAGACGAAGTGGATGTTTGACTACTGGGGTCAGGGAACCCTGGTCACCGTCTCGAGC<br>(SEQ ID NO: 735) |
| ABT2-65-142 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGATTT<br>CTGCGAGGGAGTGGATGTTTGACTACTGGGGTCAGGGAACCCTGGTCACCGTCTCGAGC<br>(SEQ ID NO: 736) |
| ABT2-65-143 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTCTGC<br>AGAGGGATAGGTGGATGTTTGACTACTGGGGTCAGGGAACCCTGGTCACCGTCTCGAGC<br>(SEQ ID NO: 737) |
| ABT2-65-144 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTGCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTATTT<br>CGAAGAAGCAGTGGATGTTTGACTACTGGGGTCAGGGAACCCTGGTCACCGTCTCGAGC<br>(SEQ ID NO: 738) |
| ABT2-65-145 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGATTC<br>AGAAGGTTAAGTGGATGTTTGACTACTGGGGTCAGGGAACCCTGGTCACCGTCTCGAGC<br>(SEQ ID NO: 739) |
| ABT2-65-146 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGACTA<br>TGAAGCGGAAGTGGATGTTTGACTACTGGGGTCAGGGAACCCTGGTCACCGTCTCGAGC<br>(SEQ ID NO: 740) |
| ABT2-65-147 | GAGGTGCAGCTGTTGGAGTCTGGGGGTGGCTTGGTGCAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGGCTTG<br>GGCGGATTCGTTGGATGTTTGACTACTGGGGTCAGGGAACCCTGGTCACCGTCTCGAGC<br>(SEQ ID NO: 741) |
| ABT2-65-148 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGGCTTG<br>GGTCGAAGAGGTGGATGTTTGACTACTGGGGTCAGGGAACCCTGGTCACCGTCTCGAGC<br>(SEQ ID NO: 742) |
| ABT2-65-149 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GAAAGGGTCTAGAGTGGGTCTCGTCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAATCTGGTTCGTGTTG<br>ATAGGAGGCGGTGGATGTTTGACTACTGGGGTCAGGGAACCCTGGTCACCGTCTCGAGC<br>(SEQ ID NO: 743) |
| ABT2-65-150 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCTGATTG<br>CGCGTGGTAAGTGGATGTTTGACTACTGGGGTCAGGGAACCCTGGTCACCGTCTCGAGC<br>(SEQ ID NO: 744) |

TABLE 64-continued

DNA sequences for ABT1 and ABT2 dAbs

| dAb Name | DNA sequence |
|---|---|
| ABT2-65-151 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTTGGA<br>GGAAGCATGCGTGGATGTTTGACTACTGGGGTCAGGGAACCCTGGTCACCGTCTCGAGC<br>(SEQ ID NO: 745) |
| ABT2-65-152 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGTTGGA<br>AGAGTTCGGCGTGGATGTTTGACTACTGGGGTCAGGGAACCCTGGTCACCGTCTCGAGC<br>(SEQ ID NO: 746) |
| ABT2-65-154 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACACACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGATTC<br>GTAGGACGAAGTGGATGTTTGACTACTGGGGTCAGGGAACCCTGGTCACCGTCTCGAGC<br>(SEQ ID NO: 747) |
| ABT2-65-155 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTTTTGGTTC<br>AGAGGAGGAAGTGGATGTTTGACTACTGGGGTCAGGGAACCCTGGTCACCGTCTCGAGC<br>(SEQ ID NO: 748) |
| ABT2-65-156 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGGATTG<br>GGCGGAATAAGTGGATGTTTGACTACTGGGGTCAGGGAACCCTGGTCACCGTCTCGAGC<br>(SEQ ID NO: 749) |
| ABT2-65-157 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACATGCTGTATCTGCAAAT<br>GAACAGCCTGCGTGCCGAGGACACCGCGGTATATTACTGTGCGGAAAATCTGGTTCGGCTTA<br>GTCTGCATCGGTGGATGTTTGACTACTGGGGTCAGGGAACCCTGGTCACCGTCTCGAGC<br>(SEQ ID NO: 750) |
| ABT2-65-158 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAAGTGGA<br>AGAGGGATTTTTGGATGTTTGACTACTGGGGTCAGGGAACCCTGGTCACCGTCTCGAGC<br>(SEQ ID NO: 751) |
| ABT2-65-159 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGGTGA<br>GTAAGGCGAGGTGGATGTTTGACTACTGGGGTCAGGGAACCCTGGTCACCGTCTCGAGC<br>(SEQ ID NO: 752) |
| ABT2-65-160 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTCCCCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTAGGTGGATGTTTGACTACTGGGGTCAGGGAACCCTGGTCACAGTCTCGAGC (SEQ ID NO: 753) |
| ABT2-65-163 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTGGGCGGACATACTACGCAGAC |

TABLE 64-continued

DNA sequences for ABT1 and ABT2 dAbs

| dAb Name | DNA sequence |
| --- | --- |
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 754) |
| ABT2-65-166 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTGGACGGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACAGTCTCGAGC<br>(SEQ ID NO: 755) |
| ABT2-65-167 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGGTGGA<br>AGAAGAATGAGTGGATGTTTGACTACTGGGGTCAGGGAACCCTGGTCACCGTCTCGAGC<br>(SEQ ID NO: 756) |
| ABT2-65-168 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGTGGA<br>AGTTGGAGTCTTGGATGTTTGACTACTGGGGTCAGGGAACCCTGGTCACCGTCTCGAGC<br>(SEQ ID NO: 757) |
| ABT2-65-169 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAATTGGC<br>GGCGTGGGTCTTGGATGTTTGACTACTGGGGTCAGGGAACCCTGGTCACCGTCTCGAGC<br>(SEQ ID NO: 758) |
| ABT2-65-170 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGGGTTC<br>TTCTTAATAAGTGGATGTTTGACTACTGGGGTCAGGGAACCCTGGTCACCGTCTCGAGC<br>(SEQ ID NO: 759) |
| ABT2-65-171 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTCGGTTGA<br>ATAGGTCGCAGTGGATGTTTGACTACTGGGGTCAGGGAACCCTGGTCACCGTCTCGAGC<br>(SEQ ID NO: 760) |
| ABT2-65-172 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTCGGTGGA<br>AGAAGGGTTCTTGGATGTTTGACTACTGGGGTCAGGGAACCCTGGTCACCGTCTCGAGC<br>(SEQ ID NO: 761) |
| ABT2-65-173 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGTTTC<br>GGGCGAAGGAGTGGATGTTTGACTACTGGGGTCAGGGAACCCTGGTCACCGTCTCGAGC<br>(SEQ ID NO: 762) |
| ABT2-65-174 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGTTTA<br>AGAAGACGCAGTGGATGTTTGACTACTGGGGTCAGGGAACCCTGGTCACCGTCTCGAGC<br>(SEQ ID NO: 763) |

TABLE 64-continued

DNA sequences for ABT1 and ABT2 dAbs

| dAb Name | DNA sequence |
|---|---|
| ABT2-65-175 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAGGATTG<br>CGGGGGATCGGTGGATGTTTGACTACTGGGGTCAGGGAACCCTGGTCACCGTCTCGAGC<br>(SEQ ID NO: 764) |
| ABT2-65-176 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAGTCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGGAAAATCTGGTTAAGGTGG<br>CGCGGGGTCGTTGGATGTTTGACTACTGGGGTCAGGGAACCCTGGTCACCGTCTCGAGC<br>(SEQ ID NO: 765) |
| ABT2-65-177 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCTTGCGTGCCGAGGACACCGCGGTATATTACTGTGCGCAAAATCTGGTTAGGTTTA<br>AGGTGCTGCAGTGGATGTTTGACTACTGGGGTCAGGGAACCCTGGTCACCGTCTCGAGC<br>(SEQ ID NO: 766) |
| ABT2-65-500 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGGTTCCAAGAACACGCTGTATCTGCAAAT<br>GAACAGCCTGCGTGCCGAGGACACCGCGGTATATTACTGTGCGCAAAATCTGGTTAGGCTGG<br>GGGGGTCTAGGTGGATGTTTGACTACTGGGGTCAGGGAACCCTGGTCACCGTCTTGAGC<br>(SEQ ID NO: 767) |
| ABT2-65-501 | GAGGTGCAGCTGTTGGAGTCTGGGGGAGGCTTGGTACAGCCTGGGGGGTCCCTGCGTCTCTC<br>CTGTGTAGCCTCCGGATTCGCCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAGGGCCGGTTCACCATCTCCCGCGACGGTTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGGTGTTTGACTACTGGGGTCAGGGAACCCTGGTCACCGTCTCGAGC<br>(SEQ ID NO: 768) |
| ABT2-65-502 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGGTTTCGGCTATGGGTAATCGGACATACTACGCAGAC<br>TCCGTGAAGGGCCGGTTCACCATTTCCCGCGACGGTTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 769) |
| ABT2-65-503 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGCGGGTCTCATCGGTTTCGGCTATGGGTAATCGGACACACTACGCAGAC<br>TCCGTGAAGGGCCGGTTCACCATCTCCCGCGACGATTCCAAGAACACGCTGTATCTGCAAAT<br>GAACAGCCTGCGTGCCGGGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 770) |
| ABT2-65-504 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGCGGGTCTCATCGGTTTCGGCTATGGGTAATCGGACACACTACGCAGAC<br>TCCGTGAAGGGCCGGTTCACCATCTCCCGCGACGATTCCAAGAACACGCTGTATCTGCAAAT<br>GAACAGCCTGCGTGCCGGGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 771) |
| ABT2-65-505 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCGGATGGGGTGGGTCCGCCAGGCTCCAG<br>GGAAGGGTCTAGAGTGGGTCTCATCGGTTTCGGCTATGGGTAATCGGACATACTACGCAGAC<br>TCCGTGAAGGGCCGGTTCACCATCTCCCGCGACGGTTCCAAGAACACGCTGTATCTGCAAAT<br>GAACAGCCTGCGTGCCGAGGACACCGCGGTATATTACTGTGCGCAAAATCTGGTTAAGCTGG<br>GGAGGTCTAGGTGGATGTTTGACTACTGGGGTCAGGGAACCCTGGTCACCGTCTCGAGC<br>(SEQ ID NO: 772) |
| ABT2-65-506 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC |

TABLE 64-continued

DNA sequences for ABT1 and ABT2 dAbs

| dAb Name | DNA sequence |
|---|---|
| | TCCGTGAAGGGCCGGTTCACCATCTCCCGCGACGATTCCAAGAACACGCTGTATCTGCAAAT<br>GAACAGCCTGCGTGCCGAGGACACCGCGGTATATTGCTGTGCGCAAAATCTGGTTAGGCTGG<br>GGAGGTCTAGGTGGATGTTTGACTACTGGGGTCAGGGAACCCTGGTCACCGTCTCAAGC<br>(SEQ ID NO: 773) |
| ABT2-65-<br>507 | GAGGTGCAGCTGTTGGAGTCTGGGGGAGGCTTGGTACAGCCTGGGGGGTCCCTGCGTCTCCC<br>CTGTGTAGCCTCCGGATTCACCTTTGAGGATTGTCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATTTCCCGCGACAATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 774) |
| ABT2-65-<br>508 | GAGGTGCAGCTGTTGGAGTCTGGGGGAGGCTTGGTACAGCCTGGGGGGTCCCTGCGTCTCTC<br>CTGTGTAGCCTCCGGATTCCCCTTTGAGGATTATCAGATGGGGTGGGTCCGCCAGGCTCCAG<br>GGGAGGGTCTAGAGTGGGCCTCATCGATTTCGGCTATGGGTAATCGGACATACTACGCAGAC<br>TCCGTGAAGGGCCGGTTCACCATCTCCCGCAACGATTCCAAGAACACGCTGTATCTGCAAAT<br>GAACAGCCTGCGTGCCGAGGACACCGCGGTATATTACTGTGCGCAAAATCTGGTTAGGCTGG<br>GGGGGTCTAGGTGGATGTTTGACTACTGGGGTCAGGGAACCCTGGTCACCGTCTCGAGC<br>(SEQ ID NO: 775) |
| ABT2-65-<br>509 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACGCCGCGGTATATTACTGTGCGCAAAATCTGGTTAGGCTGG<br>GGAGGTCTAGGTGGATGTTTGACTACTGGGGTCAGGGAACCCTGGTCACCGTCTCTAGC<br>(SEQ ID NO: 776) |
| ABT2-65-<br>510 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCGAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 777) |
| ABT2-65-<br>511 | GAGGTGCAGCTGTTGGAGTCTGGGGGAGGCTTGGTACAGCCTGGGGGGTCCCTGCGTCCCTC<br>CTGTGTAGCCTCCGGATTCACCTTTGGGGATTATCAGATGGGGTGGGTCCGCCAGGCTCCAG<br>GGAAGGGTCTAGAGTGGGTCTCATCGATTTCGGCTATGGGTAGTCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACCACTGGGGTCAGGGAACCCTGGTCACCGTCTCGAGC<br>(SEQ ID NO: 778) |
| ABT2-65-<br>512 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCACCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 779) |
| ABT2-65-<br>513 | GAGGTGCAGCTGTTGGAGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTGTGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAGAATCTGGTTAGGCTGG<br>GGAGGTCTAGGCGGATGTTTGACTACTGGGGTCAGGGAACCCTGGTCACCGTCTCGAGC<br>(SEQ ID NO: 780) |
| ABT2-65-<br>514 | GAGGTGCAGCTGTTGGAGTCTGGGGGGGGCTTGGTACAGCCTGGGGGGTCCCTGCGTCTCTC<br>CTGTGTAGCCTCCGGATTCACCTTTGAGGATTATCAAATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 781) |
| ABT2-65-<br>515 | GAGTGCAGCTGTTGGAGGTCTGGGGGAGGCTTGGTACAGCCTGGGGGGTCCCTGCGTCTCTC<br>CTGTGTAGCCTCCGGATTCACCTTTGAGGATTATCAGATGGGGTGGGTCCGCCAGGCTCCAG<br>GGAAGGGTCTAGAGTGGGTCTCATCGATTTCGGCTATGGGTAATCGGACATACTACGCAGAC<br>TCCGTGAAGGGCCGGTTCACCATCTCCCGCGACGATTCCAAGAACACGCTGTATCTGCAAAT<br>GAACAGCCTGCGTGCCGAGGACACCGCGGTATATTACTGTGCGCAAAATCTGGTTAGGCTGG<br>GGAGGTCTAGGTGGATGTTTGACTACTGGGGTCAGGGAACCCTGGTCACCGTCTCGAGC<br>(SEQ ID NO: 782) |

TABLE 64-continued

DNA sequences for ABT1 and ABT2 dAbs

| dAb Name | DNA sequence |
| --- | --- |
| ABT2-66 | GAGGTGCAGCTGTTGGAGTCTGGGGGAGGCTTGGTACAGCCTGGGGGGTCCCTGCGTCTCTC CTGTGCAGCCTCCGGATTCACCTTTTCTCATTATACTATGGCGTGGGTCCGCCAGGCTCCAG GGAAGGGTCTAGAGTGGGTCTCAACTATTGGTTCTTCTGGTAATAGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTATATTACTGTGCGCAAATGCGGGGGCCGTATT ATACTTTTGACTACCGGGGTCAGGGAACCCTGGTCACCGTCTCGAGC (SEQ ID NO: 783) |
| ABT2-69 | GAGGTGCAGCTGTTGGAGTCTGGGGGAGGCTTGGTACAGCCTGGGGGGTCCCTGCGTCTCTC CTGTGCAGCCTCCGGATTCACCTTTACGGGTTATGATATGGCTTGGGTCCGCCAGGCTCCAG GGAAGGGTCTAGAGTGGGTCTCAGTGATTTATGCTTATGGTGAGTCTACATACTACGCAGAC TCCGTGAAGGGCCGGTTCACCATCTCCCGCGACAATTCCAAGAACACGCTGTATCTGCAAAT GAACAGCCTGCGTGCCGAGGATACCGCGGTATATTACTGTGCGAAAGTGTATTCGAATCAGT TTGACTACTGGGGTCAGGGAACCCTGGTCACCGTCTCGAGC (SEQ ID NO: 784) |
| ABT2-70 | GAGGTGCAGCTGTTGGAGTCTGGGGGAGGCTTGGTACAGCCTGGGGGGTCCCTGCGTCTCTC CTGTGCAGCCTCGGATTCACCTTTAGGGCTTATGATATGGGGTGGGTCCGCCAGGCTCCAG GGAGGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTATATTACTGTGCGAAAACGTCTCCTAATGCGA GTTTTGACTGGGGTCAGGGAACCCTGGTCACCGTCTCGAGC (SEQ ID NO: 785) |
| ABT2-71 | GAGGTGCAGCTGTTGGAGTCTGGGGGAGGCTTGGTACAGCCTGGGGGGTCCCTGCGTCTCTC CTGTGCAGCCTCGGATTCACCTTTAGGGCTTATGATATGGGGTGGGTCCGCCAGGCTCCAG GGAAGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTATATTACTGTGCGAAAAGGGTCGTCAGTCGT TTGACTACTGGGGTCAGGGAACCCTGGTCACCGTCTCGAGC (SEQ ID NO: 786) |
| ABT2-72 | GAGGTGCAGCTGTTGGAGTCTGGGGGAGGCTTGGTACAGCCTGGGGGGTCCCTGCGTCTCTC CTGTGCAGCCTCCGGATTCACCTTTAGGGCTTATGATATGGGGTGGGTCCGCCAGGCTCCAG GGAAGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTATATTACTGTGCGAAAACTTCTTCTGATGGGT TTGACTACTGGGGTCAGGGAACCCTGGTCACCGTCTCGAGC (SEQ ID NO: 787) |
| ABT2-73 | GAGGTGCAGCTGTTGGAGTCTGGGGGAGGCTTGGTACAGCCTGGGGGGTCCCTGCGTCTCTC CTGTGCAGCCTCCGGATTCACCTTTAGGGCTTATGATATGGGGTGGGTCCGCCAGGCTCCAG GGAAGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTTTATTACTGTGCGAAATTTTCTCCGCTTAGGG CTCCTGTGTTTGACTACTGGGGTCAGGGAACCCTGGTCACCGTCTCGAGC (SEQ ID NO: 788) |
| ABT2-74 | GAGGTGCAGCTGTTGGAGTCTGGGGGAGGCTTGGTACAGCCTGGGGGGTCCCTGCGTCTCTC CTGTGCAGCCTCCGGATTCACCTTTGATCTGTATGATATGCATTGGGTCCGCCAGGCTCCAG GGAAGGGTCTAGAGTGGGTCTCAACGATTTATGCTTATGGTTATGCGACATACTACGCAGAC TCCGTGAAGGGCCGGTTCACCATCTCCCGCGACAATTCCAAGAACACGCTGTATCTGCAAAT GAACAGCCTGCGTGCCGAGGATACCGCGGTATATTACTGTGCGAAAAAGCATGGTATGTATG ATCATTTTGACTACTGGGGTCAGGGAACCCTGGTCACCGTCTCGAGC (SEQ ID NO: 789) |
| ABT2-75 | GAGGTGCAGCTGTTGGAGTCTGGGGGAGGCTTGGTACAGCCTGGGGGGTCCCTGCGTCTCTC CTGTGCAGCCTCCGGATTCACCTTTGGGCAGTATCCGATGGCGTGGGTCCGCCAGGCTCCAG GGAAGGGTCTAGAGTGGGTCTCAACTATTTCTCCGAAGGGTGATCGTACATACTACGCAGAC TCCGTGAAGGGCCGGTTCACCATCTCCCGCGACAATTCCAAGAACACGCTGTATCTGCAAAT GAACAGCCTGCGTGCCGAGGACACCGCGGTATATTACTGTGCGAAAGCGATGTATTCGTATC AGTATAAGGAGAAGGGTTTTGACTACTGGGGTCAGGGAACCCTGGTCACCGTCTCGAGC (SEQ ID NO: 790) |
| ABT2-99 | GAGGTGCAGCTGTTGGAGTCTGGGGGAGGCTTGGTACAGCCTGGGGGGTCCCTGCGTCTCTC CTGTACAGCCTCCGGATTCACCTTTCGTGATTATGATATGGGGTGGGTCCGCCAGGCTCCAG GGAAGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGATACCGCGGTATATTACTGTGCGAAAACTTCGTCTGTTAATT TTGACTACTGGGGTCAGGGAACCCTGGTCACCGTCTCGAGC (SEQ ID NO: 791) |
| ABT2-101 | GAGGTGCAGCTGTTGGAGTCTGGGGGAGGCTTGGTACAGCCTGGGGGGTCCCTGCGTCTCTC CTGTGCAGCCTCCGGATTCACCTTTAGGGCTTATGATATGGGGTGGGTCCGCCAGGCTCCAG GGAAGGGTCTAGAGTGGGTCTCAGTTATTTATGCGTGGGGTACTAGTACATACTACGCAGAC TCCGTGAAGGGCCGGTTCACCATCTCCCGCGACAATTCCAAGAACACGCTGTATCTGCAAAT GAACAGCCTGCGTGCCGAGGATACCGCGGTATATTACTGTGTGAAACGGGGGAGGGTAAGT TTGACTACTGGGGTCAGGGAACCCTGGTCACCGTCTCGAGC (SEQ ID NO: 792) |

TABLE 64-continued

DNA sequences for ABT1 and ABT2 dAbs

| dAb Name | DNA sequence |
|---|---|
| ABT2-104 | GAGGTGCAGCTGTTGGAGTCTGGGGGAGGCTTGGTACAGCCTGGAGGGTCCCTGCGTCTCTC<br>CTGTGCAGCCTCCGGATTCACCTTTAGGGCGTATCGGATGGGTTGGGTCCGCCAGGCTCCAG<br>GGAAGGGTCTAGAGTGGGTCTCATGGATTTGGCCTAATGGTTCTCATGCATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGCAATTCGTGATAATCAGC<br>GGTTTGACTACCGGGGTCAGGGAACCCTGGTCACCGTCTCGAGC (SEQ ID NO: 793) |
| ABT2-105 | GAGGTGCAGCTGTTGGAGTCTGGGGGAGGCTTGGTACAGCCTGGGGGGTCCCTGCGTCTCTC<br>CTGTGCAGCCTCCGGATTCACCTTTTTTGCTTATGAGATGTCGTGGGTCCGCCAGGCTCCAG<br>GGAAGGGTCTAGAGTGGGTCTCATCTATTTCTTATAATGGTACTCAGACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGATACCGCGGTATATTACTGTGCGAAAAGGCCGGATCTTTCGA<br>GTTTTGACTACTGGGGTCAGGGAACCCTGGTCACCGTCTCGAGC (SEQ ID NO: 794) |
| ABT2-106 | GAGGTGCAGCTGTTGGAGTCTGGGGGAGGCTTGGTACAGCCTGGGGGGTCCCTGCGTCTCTC<br>CTGTGCAGCCTCCGGATTCACCTTTAGTGATTATGGGATGAGTTGGGTCCGCCAGGCTCCAG<br>GGAAGGGTCTAGAGTGGGTCTCAGCTATTGCTACTGATGGCGTGTCTACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATTTTTATCCGAATT<br>TTGACTACTGGGGTCAGGGAACCCTGGTCACCGTCTCGAGC (SEQ ID NO: 795) |
| ABT2-107 | GAGGTGCAGCTGTTGGAGTCTGGGGGAGGCTTGGTACAGCCTGGGGGGTCCCTGCGTCTCTC<br>CTGTGCAGCCTCCGGATTCACCTTTCCGCCTTATGCGATGGGTTGGGTCCGCCAGGCTCCAG<br>GGAAGGGTCTGGAGTGGGTCTCATTGATTTATGAGAATGGTTTTAATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAAACTTTGGGTTCTAATT<br>TGTTTGACTACTGGGGTCAGGGAACCCTGGTCACCGTCTCGAGC (SEQ ID NO: 796) |
| ABT2-108 | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGAGTATACTATGATGTGGGTCCGCCAGGCTCCAG<br>GGAAGGGTCTCGAGTGGGTCTCACGTATTGGGCAGGATGGTAAGAATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATACGGGTCGGGTTG<br>GTGTTCATCATCTTTTTGACTACTGGGGTCAGGGAACCCTGGTCACCGTCTCGAGC (SEQ ID NO: 797) |
| ABT2-108-533X | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGACGAGGGGATGATGTGGGTCCGCCAGGCTCCAG<br>GGAAAGGTCTCGAGTGGGTCTCACGTATTGGGCAGGATGGTAAGAATACTACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATACGGGTCGGATCC<br>TCGGGCATCATCTTTTTGACTACTGGGGTCAGGGAACCCTGGTCACCGTCTCGAGC (SEQ ID NO: 798) |
| ABT2-108-534X | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGACGAGGGGATGATGTGGGTCCGCCAGGCTCCAG<br>GGAAAGGTCTCGAGTGGGTCTCACGTATTACCTACAGCGGTAAGAATACATACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATACGGGTCGGATCT<br>TCTCCCATCATCTTTTTGACTACTGGGGTCAGGGAACCCTGGTCACCGTCTCGAGC (SEQ ID NO: 799) |
| ABT2-108-537X | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGACGAGGGGATGATGTGGGTCCGCCAGGCTCCAG<br>GGAAGGGTCTCGAGTGGGTCTCACGTATTGGGCAGGATGGTAAGAATACATACTACCGGATG<br>GACGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATACGGGTCGGATCC<br>TCGGGCATCATCTTTTTGACTACTGGGGTCAGGGAACCCTGGTCACCGTCTCGAGC (SEQ ID NO: 800) |
| ABT2-108-538X | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGACGAGGGGATGATGTGGGTCCGCCAGGCTCCAG<br>GGAAGGGTCTCGAGTGGGTCTCACGTATTACCTACAGCGGTAAGAATACGTACTACGCAGAC<br>TCCGTGAAGGGCCGGTTCACCATCTCCCGCGACAATTCCAAGAACACGCTGTATCTGCAAAT<br>GAACAGCCTGCGTGCCGAGGACACCGCGGTATATTACTGTGCGAAATATACGGGTCGGATCC<br>TCGGGCATCATCTTTTTGACTACTGGGGTCAGGGAACCCTGGTCACCGTCTCGAGC (SEQ ID NO: 801) |
| ABT2-108-620X | GAGGTGCAGCTGTTGGAGTCTGGGGGAGGCTTGGTACAGCCTGGGGGGTCCCTGCGTCTCTC<br>CTGTGCAGCCTCCGGATTCACCTTTGCTGAGGAGTCGTGGATGTGGGTCCGCCAGGCTCCAG<br>GGAAGGGTCTCGAGTGGGTCTCACGTATTGGGCAGGATGGTAAGAATACATACTACCGCGAG<br>GACGTGAAGGGCCGGTTCACCATCTCCCGCGACAATTCCAAGAACACGCTATATCTGCAAAT<br>GAACAGCCTGCGTGCCGAGGACACCGCGGTATATTACTGTGCGAAATATACGGGTCGGATCA<br>TGGGCCATCATCTTTTTGACTACTGGGGTCAGGGAACCCTGGTCACCGTCTCGAGC (SEQ ID NO: 802) |

TABLE 64-continued

DNA sequences for ABT1 and ABT2 dAbs

| dAb Name | DNA sequence |
|---|---|

ABT2 VK dAbs:

ABT2-6  GACATCCAGATGACCCAGTCTCCATCCTCCCTGTCTGCATCTGTAGGAGACCGTGTCACCAT
CACTTGCCGGGCAAGTCAGAGCATTGGCTACTGTTAACTTGGTACCAGCAGAAACCAGGGA
AAGCCCCTAAGCTCCTGATCTATATGGCATCCCAGTTGCAAAGTGGGGTCCCATCACGTTTC
AGCGGCAGTGGATCTGGGACAGATTTCACTCTCACCATCAGCAGTCTGCAACCTGAAGATTT
TGCTACGTACTACTGTCAACAGTGGCATCGTCCTCCTAGTACGTTCGGCCAAGGGACCAAGG
TGGAAATCAAACGG (SEQ ID NO: 803)

ABT2-7  GACATCCAGATGACCCAGTCTCCATCCTCCCTGTCTGCATCTGTAGGAGACCGTGTCACCAT
CACTTGCCGGGCAAGTCAGAGCATTAAGTCTGGGTTAAATTGGTACCAGCAGAAACCAGGGA
AAGCCCCTAAGCTCCTGATCTATATGGCATCCCAGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGTGGCATCGTCCTCCTAGTACGTTCGGCCAAGGGACCAAGG
TGGAAATCAAACGG (SEQ ID NO: 804)

ABT2-8  GACATCCAGATGACCCAGTCTCCATCCTCCCTGTCTGCATCTGTAGGAGACCGTGTCACCAT
CACTTGCCGGGCAAGTCAGAGCATTAAGTCTATGTTAGCTTGGTACCAGCAGAAACCAGGGA
AAGCCCCTAAGCTCCTGATCTATATGGCATCCAATTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGACTATTGTTAAGCCTTCTACGTTCGGCCAAGGGACTAAGG
TGGAAATCAAACGG (SEQ ID NO: 805)

ABT2-42 GACATCCAGATGACCCAGTCTCCATCCTCCCTGTCTGCATCTGTAGGAGACCGTGTCACCAT
CACTTGCCGGGCAAGTCAGTATATTGAGAAGTGGTTAACTTGGTATCAGCAGAAACCAGGGA
AAGCCCCTACGCTCCTGATCTATCGTGGGTCCTTGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGACTGAGTATTGGCCTTTTACGTTCGGCCAAGGGACCAAGG
TGGAAATCAAACGG (SEQ ID NO: 806)

ABT2-43 GACATCCAGATGACCCAGTCTCCATCCTCCCTGTCTGCATCTGTAGGAGACCGTGTCACCAT
CACTTGCCGGGCAAGTCAGAATATTGATACGTATTTAACTTGGTACCAGCAGAAACCAGGGA
AAGCCCCTAGGCTCCTGATCTATGGGGCTTCCACGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGCGTGCTTATTATCCTACGACGTTCGGCCAAGGGACCAAGG
TGGAAATCAAACGG (SEQ ID NO: 807)

ABT2-44 GACATCCAGATGACCCAGTCTCCATCCTCCCTGTCTGCATCTGTAGGAGACCGTGTCACCAT
CACTTGCCGGGCAAGTCAGGATATTGGTGAGTGGTTAGAGTGGTATCAGCAGAAACCAGGGA
AAGCCCCTAAGCTCCTGATCTATCGGGCGTCCACTTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGCATGCGTATTATCCTTTTACGTTCGGCCAAGGGACCAAGG
TGGAAATCAAACGG (SEQ ID NO: 808)

ABT2-46 GACATCCAGATGACCCAGTCTCCATCCTCCCTGTCTGCATCTGTAGGAGACCGTGTCACCAT
CACTTGCCGGGCAAGTCAGAGTATTATTGAGTGGTTAAGTTGGTACCAGCAGAAACCAGGGA
AAGCCCCTAAGCTCCTGATCTATCGTACTTCCGTGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGAATGAGTTTTGGCCTTTTACGTTCGGCCAAGGGACCAAGG
TGGAAATCAAACGG (SEQ ID NO: 809)

ABT2-53 GACATCCAGATGACCCAGTCTCCATCCTCCCTGTCTGCATCTGTAGGAGACCGTGTCACCAT
CACTTGCCGGGCAAGTCAGAGCATTAAGAAGCATTTAGCGTGGTACCAGCAGAAACCAGGGA
AAGCCCCTAAGCTCCTGATCTATAATGCATCCAAGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGACTAAGCGGGAGCCTAAGACGTTTGGCCAAGGGACCAAGG
TGGAAATCAAACGG (SEQ ID NO: 810)

ABT2-54 GACATCCAGATGACCCAGTCTCCATCCTCCCTGTCTGCATCTGTAGGAGACCGTGTCACCAT
CACTTGCCGGGCAAGTCAGAGCATTAAGTCTGGGTTAAATTGGTACCAGCAGAAACCAGGGA
AAGCCCCTAAGCTCCTGATCTATATGGCATCCCAGTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGTGGCATCGTCCTCCTAGTACGTTCGGCCAAGGGACCAAGG
TGGAAATCAAACGG (SEQ ID NO: 811)

ABT2-55 GACATCCAGATGACCCAGTCTCCATCCTCCCTGTCTGCATCTGTAGGAGACCGTGTCACCAT
CACTTGCCGGGCAAGTCAGAGCATTAAGACTAGGTTAAATTGGTACCAGCAGAAACCAGGGA
AAGCCCCTAAGCTCCTGATCTATCTGGCATCCGTTTGCAAAGTGGGGTCCCATCACGTTTC
AGTGGCAGTGGATCTGGGACAGATTTCACTCTCACCATCAGCAGTCTGCAACCTGAAGATTT
TGCTACGTACTACTGTCAACAGGTGTGGCGTCTTCCTAGTACGTTCGGCCAAGGGACCGG
TGGAAATCAAACGG (SEQ ID NO: 812)

ABT2-56 GACATCCAGATGACCCAGTCTCCATCCTCCCTGTCTGCATCTGTAGGAGACCGTGTCACCAT
CACCTGCCGGGCAAGTCAGAGCATTGGGAGGCGGTTAAGTTGGTACCAGCAGAAACCAGGGA
AAGCCCCTAAGCTCCTGATCTATAAGGCATCCCGTTTGCAAAGTGGGGTCCCATCACGTTTC

TABLE 64-continued

DNA sequences for ABT1 and ABT2 dAbs

| dAb Name | DNA sequence |
|---|---|
| | AGTGGCAGTGGATCTGGGACAGATTTCACTCTCACCATCAGCAGTCTGCAACCTGAAGATTTT<br>TGCTACGTACTACTGTCAACAGCGTGTTAGTGTTCCTCGGACGTTCGGCCAAGGGACCAAGG<br>TGGAAATCAAACGG (SEQ ID NO: 813) |
| ABT2-57 | GACATCCAGATGACCCAGTCTCCATCCTCCCTGTCTGCATCTGTAGGAGACCGTGTCACCAT<br>CACTTGCCGGGCAAGTCAGAGCATTGCGCGTCAGTTAGCGTGGTACCAGCAGAAACCAGGGA<br>AAGCCCCTAAGCTCCTGATCTATAAGGCATCCCGGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTATCGGATGCGGCCTAAGACGTTCGGCCAAGGGACCAAGG<br>TGGAAATCAAACGG (SEQ ID NO: 814) |
| ABT2-58 | GACATCCAGATGACCCAGTCTCCATCCTCCCTGTCTGCATCTGTAGGAGACCGTGTCACCAT<br>CACTTGCCGGGCAAGTCAGAGCATTTCTAAGAAGTTAGATTGGTACCAGCAGAAACCAGGGA<br>AAGCCCCTAAGCTCCTGATCTATTCGGCATCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGGCGGCGTAAGCCTACTACGTTCGGCCAAGGGACCAAGG<br>TGGAAATCAAACGG (SEQ ID NO: 815) |
| ABT2-59 | GACATCCAGATGACCCAGTCTCCATCCTCCCTGTCTGCATCTGTAGGAGACCGTGTCACCAT<br>CACTTGCCGGGCTAGTCAGAGCATTAATGTATTTTTATCGTGGTACCAGCAGAAACCAGGGA<br>AAGCCCCTAAGCTCCTGATCTATAATGCATCCAATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGGCTCTTTATCCTACTACGTTCGGCCAAGGGACCAAGG<br>TGGAAATCAAACGG (SEQ ID NO: 816) |
| ABT2-60 | GACATCCAGATGACCCAGTCTCCATCCTCCCTGTCTGCATCTGTAGGAGACCGTGTCACCAT<br>CACTTGCCGGGCAAGTCAGAGCATTAGGGTTTTTTTATCTTGGTACCAGCAGAAACCAGGGA<br>AAGCCCCTAAGCTCCTGATCTATAATGCATCCAATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGGCTCTTTATCCTACTACGTTCGGCCAAGGGACCAAGG<br>TGGAAATCAAACGG (SEQ ID NO: 817) |
| ABT2-61 | GACATCCAGATGACCCAGTCTCCATCCTCCCTGTCTGCATCTGTAGGAGACCGTGTCACCAT<br>CACTTGCCGGGCAAGTCAGAGCATTAGGGTTTTTTTATCTTGGTATCAGCAGAAACCAGGGA<br>AAGCCCCTAAGCTCCTGATCTATAACGCATCCCATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGGCTCTTTATCCTACTACGTTCGGCCAAGGGACCAAGG<br>TGGAAATCAAACGG (SEQ ID NO: 818) |
| ABT2-62 | GACATCCAGATGACCCAGTCTCCATCCTCCCTGTCTGCATCTGTAGGAGACCGTGTCACCAT<br>CACTTGCCGGGCAAGTCAGAGCATTCAGACTTATTTAAGTTGGTATCAGCAGAAACCAGGGA<br>AAGCCCCTAAGCTCCTGATCTATAATGCATCCAATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGGCTCTTTATCCTACTACGTTCGGCCAAGGGACCAAGG<br>TGGAAATCAAACGG (SEQ ID NO: 819) |
| ABT2-63 | GACATCCAGATGACCCAGTCTCCATCCTCCCTGTCTGCATCTGTAGGAGACCGTGTCACCAT<br>CACTTGCCGGGCAAGTCAGAGCATTAGGGTTTTTTTATCTTGGTATCAGCAGAAACCAGGGA<br>AAGCCCCTAAGCTCCTGATCTATAATGCATCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCGGGCTCTTTATCCTACTACGTTCGGCCAAGGGACCAAGG<br>TGGAAATCAAACGG (SEQ ID NO: 820) |
| ABT2-67 | GACATCCAGATGACCCAGTCTCCATCCTCCCTGTCTGCATCTGTAGGAGACCGAGTCACCAT<br>CACTTGCCGGGCAAGTCAGTATATTGGGGAGCATTTAGCTTGGTACCAGCAGAAACCGGGGA<br>AAGCCCCTAAGCTCCTGATCTATCATAATTCCGCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATGCGTTTCTTCCTAATACGTTCGGCCAAGGGACCAAGG<br>TGGAAATCAAACGG (SEQ ID NO: 821) |
| ABT2-68 | GACATCCAGATGACCCAGTCTCCATCCTCCCTGTCTGCATCTGTAGGAGACCGTGTCACCAT<br>CACTTGCCGGGCAAGTCAGAATATTGGTATCATTTAAATTGGTACCAGCAGAAACCAGGGA<br>AAGCCCCTAAGCTCCTGATCTATCTTGGTTCCCGGTTGCAAAGTGGGTCCCATCACGTTTC<br>AGTGGCAGTGGATCTGGGACAGATTTCACTCTCACCATCAGCAGTCTGCAACCTGAAGATTT<br>CGCTACGTACTACTGTCAACAGATTCATCATGATCCTTTTACGTTCGGCCAAGGGACCAAGG<br>TGGAAATCAAACGG (SEQ ID NO: 822) |
| ABT2-76 | GACATCCAGATGACCCAGTCTCCATCCTCCCTGTCTGCATCTGTAGGAGACCGTGTCACCAT<br>CACTTGCCGGGCAAGTCAGTCGATTGATCGGTGGTTAGCGTGGTATCAGCAGAAACCAGGGA<br>AAGCCCCTAAGCTCCTGATCTATCGGGGTTCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGTTGCGTTTTGGCCTCCTACGTTCGGCCAAGGGACCAAGG<br>TGGAAATCAAACGG (SEQ ID NO: 823) |
| ABT2-77 | GACATCCAGATGACCCAGTCTCCATCCTCCCTGTCTGCATCTGTAGGAGACCGTGTCACCAT<br>CACTTGCCGGGCAAGTCAGAATATTGGGGCGCATTTAAAGTGGTATCAGCAGAAACCAGGGA |

TABLE 64-continued

DNA sequences for ABT1 and ABT2 dAbs

| dAb Name | DNA sequence |
|---|---|
| | AAGCCCCTAAGCTCCTGATCTATCGTACTTCCCGGTTGCAAAGTGGGGTCCCATCACGTTTC<br>AGTGGCAGTGGATCTGGGACAGATTTTACTCTCACCATCAGCAGTCTGCAACCTGAAGATTT<br>TGCTACGTACTACTGTCAACAGAATCATACTCGTCCTCATACGTTCGGCCAAGGGACCAAGG<br>TGGAAATCAAACGG (SEQ ID NO: 824) |
| ABT2-79 | GACATCCAGATGACCCAGTCTCCATCCTCCCTGTCTGCATCTGTAGGAGACCGTGTCACCAT<br>CACTTGCCGGGCAAGTCAGCAGATTGGTGAGTGGTTAAATTGGTATCAGCAGAAACCAGGGA<br>AAGCCCCTAAGCTCCTGATCTATCGGACGTCCCTGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACTAATTTTTGGCCTCCTACGTTCGGCCAAGGGACCAAGG<br>TGGAAATCAAACGG (SEQ ID NO: 825) |
| ABT2-80 | GACATCCAGATGACCCAGTCTCCATCCTCCCTGTCTGCATCTGTAGGAGACCGTGTCACCAT<br>CACTTGCCGGGCAAGTCAGGCTATTTATCATAATTTAAAGTGGTACCAGCAGAAACCAGGGA<br>AGGCCCCTAAGCTCCTGATCTATCATACGTCCTATTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACGTGGGCTTATCCTTATACGTTCGGCCAAGGGACCAAGG<br>TGGAAATCAAACGG (SEQ ID NO: 826) |
| ABT2-81 | GACATCCAGATGACCCAGTCTCCATCCTCCCTGTCTGCATCTGTAGGAGACCGTGTCACCAT<br>CACTTGCCGGGCAAGTCAGCCGATTTATACTGAGTTATCTTGGTATCAGCAGAAACCAGGGA<br>AAGCCCCTAAGCTCCTGATCTATGGTTCGTCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGTTTGCGTATCATCCTGTGACGTTCGGCCAAGGGACCAAGG<br>TGGAAATCAAACGG (SEQ ID NO: 827) |
| ABT2-83 | GACATCCAGATGACCCAGTCTCCATCCTCCCTGTCTGCATCTGTAGGAGACCGTGTCACCAT<br>CACTTGCCGGGCAAGTCAGCCTATTCAGACTAAGTTAGCGTGGTATCAGCAGAAACCAGGGA<br>AAGCCCCTAAGCTCCTGATCTATCATAATTCCATTTTGCAAAGTGGGGTCCCATCACGTTTC<br>AGTGGCAGTGGATCTCGGGACAGATTTCACTCTCACCATCAGCAGTCTGCAACCTGAAGATTT<br>TGCTACGTACTACTGTCAACAGTTTCGTAAGCATCCTTTTACGTTCGGCCAAGGGACCAAGG<br>TGGAAATCAAACGG (SEQ ID NO: 828) |
| ABT2-84 | GACATCCAGATGACCCAGTCTCCATCCTCCCTGTCTGCATCTGTAGGAGACCGTGTCACCAT<br>CACTTGCCGGGCAAGTCAGATTATTGATACGTGGTTAAATTGGTATCAGCAGAAACCAGGGA<br>AAGCCCTTAAGCTCCTGATCTATCGTACTTCCTCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGTAATTATTGGCCTGCTACGTTTGGCCAAGGGACCAAGG<br>TGGAAATCAAACGG (SEQ ID NO: 829) |
| ABT2-85 | GACATCCAGATGACCCAGTCTCCATCCTCCCTGTCTGCATCTGTAGGAGACCGTGTCACCAT<br>CACTTGCCGGGCAAGTCAGAGGATTCGTAAGCGTTTAAAGTGGTATCAGCAGAAACCAGGGA<br>AAGCCCCTAAGCTCCTGATCTATTCGTCGTCCAAGTTGCAAAGTGGGGTCCCATCACGTTTC<br>AGCGGCAGTGGATCTGGGACAGATTTCACTCTCACCATCAGCAGTCTGCAACCTGAAGATTT<br>TGCTACGTACTACTGTCAACAGAATTTTTCTAAGCCTTCGACGTTCGGCCAAGGGACCAAGG<br>TGGAAATCAAACGG (SEQ ID NO: 830) |
| ABT2-86 | GACATCCAGATGACCCAGTCTCCATCCTCCCTGTCTGCATCTGTAGGAGACCGTGTCACCAT<br>CACTTGCCGGGCAAGTCAGAGTATTAAGAAGTATTTAGCTTGGTATCAGCAGAAACCAGGGA<br>AAGCCCCTAAGCTCCTGATCTATCTGGCTTCCACGTTGCAAAGTGGGGTCCCATCACGTTTC<br>AGTGGCAGTGGATCTGGGACAGATTTCACTCTCACCATTAGCAGTCTGCAACCTGAAGATTT<br>CGCTACGTACTACTGTCAACAGACGCTGACGTATCCTTCTACGTTCGGCCAAGGGACTAAGG<br>TGGAAATCAAACGG (SEQ ID NO: 831) |
| ABT2-87 | GACATCCAGATGACCCAGTCTCCATCCTCCCTGTCTGCATCTGTAGGAGACCGTGTCACCAT<br>CACTTGCCGGGCAAGTCAGTCGATTAGTGTTTATTTATCTTGGTATCAGCAGAAACCAGGGA<br>AAGCCCCTAAGCTCCTGATCTATAATGCTTCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAGGGCTCATTATCCTACTACGTTCGGCCAAGGGACCAAGG<br>TGGAAATCAAACGG (SEQ ID NO: 832) |
| ABT2-88 | GACATCCAGATGACCCAGTCTCCATCCTCCCTGTCTGCATCTGTAGGAGACCGTGTCACCAT<br>CACTTGCCGGGCAAGTCAGTCTATTGATGAGTGGTTAGAGTGGTACAGCAGAAACCAGGGA<br>AAGCCCCTAAGCTCCTGATCTATCGTGCGTCCCGTTTGCAAAGTGGGGTCCCATCACGTTTC<br>AGTGGCAGTGGATCTGGGACAGATTTCACTCTCACCATCAGCAATCTGCAACCTGAAGATTT<br>TGCTACGTACTACTGTCAACAGGCGGCTTCGTGGCCTCGTACGTTCGGCCAAGGGACCAAGG<br>TGGAAATCAAACGG (SEQ ID NO: 833) |
| ABT2-89 | GACATCCAGATGACCCAGTCTCCATCCTCCCTGTCTGCATCTGTAGGAGACCGTGTCACCAT<br>CACTTGCCGGGCAAGTCAGTCGATTGATCGGTGGTTAGCGTGGTATCAGCAGAAACCAGGGA<br>AAGCCCCTAAGCTCCTGATCTATCGGGTTCCATTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGGTTGCGTTTTGGCCTCCTACGTTCGGCCAAGGGACCAAGG<br>TGGAAATCAAACGG (SEQ ID NO: 834) |

TABLE 64-continued

DNA sequences for ABT1 and ABT2 dAbs

| dAb Name | DNA sequence |
|---|---|
| ABT2-90 | GACATCCAGATGACTCAGTCTCCATCCTCCCTGTCTGCATCTGTAGGAGACCGTGTCACCAT<br>CACTTGCCGGGCAAGTCAGAATATTGATCAGTGGTTAGCGTGGTACCAGCAGAAACCAGGGA<br>AAGCCCCTAAGCTCCTGATCTATCGGACGTCCCGTTTGCAAAGTGGGGTCCCATCACGTTTC<br>AGTGGCAGTGGATCTCGGGACAGATTTCACTCTCACCATCAGCAGTCTGCAACCTGAAGATTT<br>CGCTACGTACTACTGTCAACAGGTTGCTGCGTTTCCTGCTACGTTCGGCCAAGGGACCAAGG<br>TGGAAATCAAACGG (SEQ ID NO: 835) |
| ABT2-91 | GACATCCAGATGACCCAGTCTCCATCCTCCCTGTCTGCATCTGTAGGAGACCGTGTCACCAT<br>CACTTGCCGGGCAAGTCAGCTTATTGGGAAGCATTTAAATTGGTATCAGCAGAAACCAGGGA<br>AAGCCCCTAAGCTCCTGATCTATCATGAGTCCGCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATGCGTTTTCTCCTCATACGTTCGGCCAAGGGACCAAGG<br>TGGAAATCAAACGG (SEQ ID NO: 836) |
| ABT2-93 | GACATCCAGATGACCCAGGCTCCATCCTCCCTGTCTGCATCAGTAGGAGACCGTGTCACCAT<br>CACTTGCCGGGCAAGTCAGTCGATTGGTCCGCATTTAAATTGGTACCAGCAGAAACCAGGGA<br>AAGCCCCTAAGCTCCTGATCTATCATATTTCCACTTTGCAAAGTGGGGTCCCATCACGTTTC<br>AGTGGCAGTGGATCTGGGACAGATTTCACTCTCACCATCAGCAGTCCGCAACCTGAAGATTT<br>TGCTACGTACTACTGTCAGCAGCATGCGTTTTCTCCTCATACGTTCGGCCAAGGGACCAAGG<br>TGGAAATCAAACGG (SEQ ID NO: 837) |
| ABT2-94 | GACATCCAGATGACCCAGTCTCCATCCTCCCTGTCTGCATCTGTAGGAGACCGTGTCACCAT<br>CACTTGCCGGGCAAGTCAGGCGATTGGTATTCATTTAGATTGGTACCAGCAGAAACCAGGGA<br>AAGCCCCTAAGCTCCTGATCTATGATACTTCCTCTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGCATGCGCTTTTGCCTCATACGTTCGGCCAAGGGACCAAGG<br>TGGAAATCAAACGG (SEQ ID NO: 838) |
| ABT2-95 | GACATCCAGATGACCCAGTCTCCATCCTCCCTGTCTGCATCTGTAGGAGACCGTGTCACCAT<br>CACTTGCCGGGCAAGTCAGTTTATTGGTCATTATTTAGCTTGGTATCAGCAGAAACCAGGGA<br>AAGCCCCTAAGCTCCTGATCTATCCGGCGTCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGACTTATCTGAATCCTACGACGTTCGGCCAAGGGACCAAGG<br>TGGAAATCAAACGG (SEQ ID NO: 839) |
| ABT2-96 | GACATCCAGATGACCCAGTCTCCATCCTCCCTGTCTGCATCTGTAGGAGACCGTGTCACCAT<br>CACTTGCCGGGCAAGTCAGGGTATTAAGAGGAAGTTAAAGTGGTACCAGCAGAAACCAGGGA<br>AAGCCCCTAAGCTCCTGATCTATCAGGCTTCCCGTTTGCAAAGTGGGGTCCCATCACGTTTC<br>AGTGGCAGTGGATCTGGGACAGATTTCACTCTCACCATCAGCAGTCTGCAACCTGAAGATTT<br>TGCTACGTACTACTGTCAACAGAATGCGCAGCGTCCTTTTACGTTCGGCCAAGGGACCAAGG<br>TGGAAATCAAACGG (SEQ ID NO: 840) |
| ABT2-97 | GACATCCAGATGACCCAGTCTCCATCCTCCCTGTCTGCATCTGTAGGAGACCGTGTCACCAT<br>CACTTGCCGGGCAAGTCAGCAGATTGATCAGTGGTTATCGTGGTACCAGCAGAAACCAGGGA<br>AAGCCCCTAAGCTCCTGATCTATCGGACTTCCTTGTTGCAAAGTGGGGTCCCATCACGTTTC<br>AGTGGCAGTGGATCTGGGACAGATTTCACTCTCACCATCAGCAGCCTGCAACCTGAAGATTT<br>TGCTACGTACTACTGTCAACAGGCTGAGTATTGGCCTTTTACGTTCGGCCAAGGGACCAAGG<br>TGGAAATCAAACGG (SEQ ID NO: 841) |
| ABT2-98 | GACATCCAGATGACCCAGTCTCCATCCTCCCTGTCTGCATCTGTAGGAGACCGTGTTACCAT<br>CACTTGCCGGGCAAGTCAGTATATTGGTAATAATTTACATTGGTACCAGCAGAAACCAGGGA<br>AAGCCCCTAAGCTCCTGATCTATAAGGGGTCCAAGTTGCAAAGTGGGGTCCCATCACGTTTC<br>AGTGGCAGTGGATCTGGGACAGATTTCACTCTCACCATCAGCAGTCTGCAACCTGAAGATTT<br>CGCTACGTACTACTGTCAACAGAATTCTGCTCGTCCTCATACGTTCGGCCAAGGGACCAAGG<br>TGGAAATCAAACGG (SEQ ID NO: 842) |

Forming part of the present disclosure is the appended Sequence Listing.

EQUIVALENTS

Those skilled in the art will recognize, or be able to ascertain using no more than routine experimentation, many equivalents to the specific embodiments of the invention described herein. Such equivalents are intended to be encompassed by the following claims. The contents of all references, patents and published patent applications cited throughout this application are incorporated herein by reference

SEQUENCE LISTING (1292 sequences)

SEQ ID NO: 1 - protein, 6 aa, Artificial Sequence
  Description of Artificial Sequence: Synthetic peptide CDR1 ABT1-6-23 (VH)
VRYDMA

SEQ ID NO: 2 - protein, 16 aa, Artificial Sequence
  Description of Artificial Sequence: Synthetic peptide CDR2 ABT1-6-23 (VH)
SIYKSGALTSYDSVKG

SEQ ID NO: 3 - protein, 7 aa, Artificial Sequence
  Description of Artificial Sequence: Synthetic peptide CDR3 ABT1-6-23 (VH)
GWASFDY

SEQ ID NO: 4 - protein, 115 aa, Artificial Sequence
  Description of Artificial Sequence: Synthetic polypeptide ABT1-6-23 (VH)
EVQLLESGGGLVQPGGSLRLSCAASGFTFVRYDMAWVRQAPGKGLEWVSSIYKSGALTSYDSVKGRFTISRDNSKNTLYLQMNSLRAEDTAVYYCAKGWASFDYWGQGTLVTVSS

SEQ ID NO: 5 - protein, 5 aa, Artificial Sequence
  Description of Artificial Sequence: Synthetic peptide CDR1 ABT1-86
RYIMA

SEQ ID NO: 6 - protein, 17 aa, Artificial Sequence
  Description of Artificial Sequence: Synthetic peptide CDR2 ABT1-86
SITPSGAATYYADSVKG

SEQ ID NO: 7 - protein, 13 aa, Artificial Sequence
  Description of Artificial Sequence: Synthetic peptide CDR3 ABT1-86
EPADRYSTWTFDY

SEQ ID NO: 8 - protein, 122 aa, Artificial Sequence
  Description of Artificial Sequence: Synthetic polypeptide ABT1-86(VH)
EVQLLESGGGLVQPGGSLRLSCAASGFTFDRYIMAWVRQAPGKGLEWVSSITPSGAATYYADSVKGRFTISRDNSKNTLYLQMNSLRAEDTAVYYCAEEPADRYSTWTFDYWGQGTLVTVSS

SEQ ID NO: 9 - protein, 11 aa, Artificial Sequence
  Description of Artificial Sequence: Synthetic peptide CDR1 ABT1-95
RASQPIHGNLR

SEQ ID NO: 10 - protein, 7 aa, Artificial Sequence
  Description of Artificial Sequence: Synthetic peptide CDR2 ABT1-95
NISNLQS

SEQ ID NO: 11 - protein, 9 aa, Artificial Sequence
  Description of Artificial Sequence: Synthetic peptide CDR3 ABT1-95
QQGYRWPVT

SEQ ID NO: 12 - protein, 108 aa, Artificial Sequence
  Description of Artificial Sequence: Synthetic polypeptide ABT1-95 Vk
DIQMTQSPSSLSASVGDRVTITCRASQPIHGNLRWYQQKPGKAPKLLIYNISNLQSGVPSRFSGSGSGTDFTLTISSLQPEDFATYYCQQGYRWPVTFGQGTKVEIKR

SEQ ID NO: 13 - protein, 5 aa, Artificial Sequence
  Description of Artificial Sequence: Synthetic peptide CDR1 ABT1-96
QYNMF

SEQ ID NO: 14 - protein, 16 aa, Artificial Sequence
  Description of Artificial Sequence: Synthetic peptide CDR2 ABT1-96
VISGSGRFTYADSVKG

SEQ ID NO: 15 - protein, 11 aa, Artificial Sequence
  Description of Artificial Sequence: Synthetic peptide CDR3 ABT1-96
GWWRRDPPFDY

SEQ ID NO: 16 - protein, 119 aa, Artificial Sequence
  Description of Artificial Sequence: Synthetic polypeptide ABT1-96 VH
EVQLLESGGGLVQPGGSLRLSCAASGFTFNQYNMFWVRQAPGKGLEWVSVISGSGRFTYADSVKGRFTISRDNSKNTLYLQMNSLRAEDTAVYYCAKGWWRRDPPFDYWGQGTLVTVSS

SEQ ID NO: 17 - protein, 5 aa, Artificial Sequence
  Description of Artificial Sequence: Synthetic peptide CDR1 ABT1-98
GYIMS

SEQ ID NO: 18 - protein, 17 aa, Artificial Sequence
  Description of Artificial Sequence: Synthetic peptide CDR2 ABT1-98
TISPLGSVTYYADSVKG

SEQ ID NO: 19 - protein, 7 aa, Artificial Sequence
  Description of Artificial Sequence: Synthetic peptide CDR3 ABT1-98
KGPWFDY

SEQ ID NO: 20 - protein, 116 aa, Artificial Sequence
  Description of Artificial Sequence: Synthetic polypeptide ABT1-98 VH
EVQLLESGGGLVQPGGSLRLSCAASGFTFDGYIMSWVRQAPGKGLEWVSTISPLGSVTYYADSVKGRFTISRDNSKNTLYLQMNSLRAEDTAVYYCAKKGPWFDYWGQGTLVTVSS

SEQ ID NO: 21 - protein, 11 aa, Artificial Sequence
  Description of Artificial Sequence: Synthetic peptide CDR1 ABT1-122
RASQPIWTELN

SEQ ID NO: 22 - protein, 7 aa, Artificial Sequence
  Description of Artificial Sequence: Synthetic peptide CDR2 ABT1-122
GSSSLQS

SEQ ID NO: 23 - protein, 9 aa, Artificial Sequence
  Description of Artificial Sequence: Synthetic peptide CDR3 ABT1-122
QQFAYFPAT

SEQ ID NO: 24 - protein, 107 aa, Artificial Sequence
  Description of Artificial Sequence: Synthetic polypeptide ABT1-122 Vk
DIQMTQSPSSLSASVGDRVTITCRASQPIWTELNWYQQKPGKAPKLLIYGSSSLQSGVPRFSGSGSGTDFTLTISSLQPEDFATYYCQQFAYFPATFGQGTKVEIKR

SEQ ID NO: 25 - protein, 11 aa, Artificial Sequence
  Description of Artificial Sequence: Synthetic peptide CDR1 ABT1-141
RASQWIQKQLA

SEQ ID NO: 26 - protein, 7 aa, Artificial Sequence
  Description of Artificial Sequence: Synthetic peptide CDR2 ABT1-141
SSSYLQS

SEQ ID NO: 27 - protein, 9 aa, Artificial Sequence
  Description of Artificial Sequence: Synthetic peptide CDR3 ABT1-141
QQHLRVPFT

SEQ ID NO: 28 - protein, 107 aa, Artificial Sequence
  Description of Artificial Sequence: Synthetic polypeptide ABT1-141 Vk
DIQMTQSPSSLSASVGDRVTITCRASQWIQKQLAWYQQKPGKAPKLLIYSSSYLQSGVPRFSGSGSGTDFTLTISSLQPEDFATYYCQQHLRVPFTFGQGTKVEIKR

SEQ ID NO: 29 - protein, 5 aa, Artificial Sequence
  Description of Artificial Sequence: Synthetic peptide CDR1 ABT2-13
DYVMY

SEQ ID NO: 30 - protein, 17 aa, Artificial Sequence
  Description of Artificial Sequence: Synthetic peptide CDR2 ABT2-13
RIDPMGSSTYYADSVKG

SEQ ID NO: 31 - protein, 7 aa, Artificial Sequence
  Description of Artificial Sequence: Synthetic peptide CDR3 ABT2-13
PEGNFDY

SEQ ID NO: 32 - protein, 116 aa, Artificial Sequence
  Description of Artificial Sequence: Synthetic polypeptide ABT2-13 VH
EVQLLESGGGLVQPGGSLRLSCAASGFTFRDYVMYWARQAPGKGLEWVSRIDPMGSSTYYADSVKGRFTISRDNSKNTLYLQMNSLRAEDTAVYYCAKPEGNFDYWGQGTLVTVSS

SEQ ID NO: 33 - protein, 11 aa, Artificial Sequence
  Description of Artificial Sequence: Synthetic peptide CDR1 ABT2-42
RASQYIEKWLT

SEQ ID NO: 34 - protein, 7 aa, Artificial Sequence
  Description of Artificial Sequence: Synthetic peptide CDR2 ABT2-42
RGSLLQS

SEQ ID NO: 35 - protein, 9 aa, Artificial Sequence
  Description of Artificial Sequence: Synthetic peptide CDR3 ABT2-42
QQTEYWPFT

SEQ ID NO: 36 - protein, 107 aa, Artificial Sequence
  Description of Artificial Sequence: Synthetic polypeptide ABT2-42 Vk
DIQMTQSPSSLSASVGDRVTITCRASQYIEKWLTWYQQKPGKAPTLLIYRGSLLQSGVPRFSGSGSGTDFTLTISSLQPEDFATYYCQQTEYWPFTFGQGTKVEIKR

SEQ ID NO: 37 - protein, 11 aa, Artificial Sequence
  Description of Artificial Sequence: Synthetic peptide CDR1 ABT2-46
RASQSIIEWLS

SEQ ID NO: 38 - protein, 7 aa, Artificial Sequence
  Description of Artificial Sequence: Synthetic peptide CDR2 ABT2-46
RTSVLQS

SEQ ID NO: 39 - protein, 9 aa, Artificial Sequence
  Description of Artificial Sequence: Synthetic peptide CDR3 ABT2-46
QQNEFWPFT

SEQ ID NO: 40 - protein, 108 aa, Artificial Sequence
  Description of Artificial Sequence: Synthetic polypeptide ABT2-46n Vk
DIQMTQSPSSLSASVGDRVTITCRASQSIIEWLSWYQQKPGKAPKLLIYRTSVLQSGVPSRFSGSGSGTDFTLTISSLQPEDFATYYCQQNEFWPFTFGQGTKVEIKR

SEQ ID NO: 41 - protein, 5 aa, Artificial Sequence
  Description of Artificial Sequence: Synthetic peptide CDR1 ABT2-65
DYQMG

SEQ ID NO: 42 - protein, 17 aa, Artificial Sequence
  Description of Artificial Sequence: Synthetic peptide CDR2 ABT2-65
SISAMGNRTYYADSVKG

SEQ ID NO: 43 - protein, 14 aa, Artificial Sequence
  Description of Artificial Sequence: Synthetic peptide CDR3 ABT2-65
NLVRTQSKMWMFDY

SEQ ID NO: 44 - protein, 123 aa, Artificial Sequence
  Description of Artificial Sequence: Synthetic polypeptide ABT2-65 VH
EVQLLESGGGLVQPGGSLRLSCAASGFTFEDYQMGWVRQAPGKGLEWVSSISAMGNRTYYADSVKGRFTISRDDSKNTLYLQMNSLRAEDTAVYYCAKNLVRTQSKMWMFDYWGQGTLVTVSS

SEQ ID NO: 45 - protein, 11 aa, Artificial Sequence
  Description of Artificial Sequence: Synthetic peptide CDR1 ABT2-76
RASQSIDRWLA

SEQ ID NO: 46 - protein, 7 aa, Artificial Sequence
  Description of Artificial Sequence: Synthetic peptide CDR2 ABT2-76
RGSILQS

SEQ ID NO: 47 - protein, 9 aa, Artificial Sequence
  Description of Artificial Sequence: Synthetic peptide CDR3 ABT2-76
QQVAFWPPT

SEQ ID NO: 48 - protein, 108 aa, Artificial Sequence
  Description of Artificial Sequence: Synthetic polypeptide ABT2-76 Vk
DIQMTQSPSSLSASVGDRVTITCRASQSIDRWLAWYQQKPGKAPKLLIYRGSILQSGVPSRFSGSGSGTDFTLTISSLQPEDFATYYCQQVAFWPPTFGQGTKVEIKR

SEQ ID NO: 49 - protein, 5 aa, Artificial Sequence
  Description of Artificial Sequence: Synthetic peptide CDR1 ABT2-108
EYTMM

SEQ ID NO: 50 - protein, 17 aa, Artificial Sequence
  Description of Artificial Sequence: Synthetic peptide CDR2 ABT2-108
RIGQDGKNTYYADSVKG

SEQ ID NO: 51 - protein, 13 aa, Artificial Sequence
  Description of Artificial Sequence: Synthetic peptide CDR3 ABT2-108
YTGRVGVHHLFDY

SEQ ID NO: 52 - protein, 121 aa, Artificial Sequence
  Description of Artificial Sequence: Synthetic polypeptide ABT2-108 Vh
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRVGVHHLFDYWGQGTLVTSS

SEQ ID NO: 53 - protein, 116 aa, Artificial Sequence
  Description of Artificial Sequence: Synthetic polypeptide
  Chemically synthesized VH Dummy
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKSYGAFDYWGQGTLVTVSS

SEQ ID NO: 54 - protein, 120 aa, Artificial Sequence
  Description of Artificial Sequence: Synthetic polypeptide ABT1-207
EVQLLESGGGLIQPGGSLRLSCAASGFTFGRYYMSWVRQAPGKGLEWVSSIDYLGTNTYYADSVKGRFTISRDNSKNTLYLQMNSLRAEDTAVYYCAKLTRIRPPNFDYWGQGTLVTVSS

SEQ ID NO: 55 - protein, 116 aa, Artificial Sequence
  Description of Artificial Sequence: Synthetic polypeptide ABT1-6
EVQLLESGGGLVQPGGSLRLSCAASGFTFGAYDMQWVRQAPGKGLEWVSSINKSGALTSYADSVKGRFTISRDNSKNTLYLQMNSLRAEDTAVYYCAKGWASFDYWGQGTLVTVSS

SEQ ID NO: 56 - protein, 116 aa, Artificial Sequence
  Description of Artificial Sequence: Synthetic polypeptide ABT1-6-15
EVQLLESGGGLVQPGGSLRLSCAASGFTFVRYDMAWVRQAPGKGLEWVSSINKSGALTSYADSVKGRFTISRDNSKNTLYLQMNSLRAEDTAVYYCAKGWASFDYWGQGTLVTVSS

SEQ ID NO: 57 - protein, 116 aa, Artificial Sequence
  Description of Artificial Sequence: Synthetic polypeptide ABT1-6-3
EVQLLESGGGLVQPGGSLRLSCAASGFTFGAYDMQWVRQAPGKGLEWVSSIYKSGALTSYADSVKGRFTISRDNSKNTLYLQMNSLRAEDTAVYYCAKGWASFDYWGQGTLVTVSS

SEQ ID NO: 58 - protein, 120 aa, Artificial Sequence
  Description of Artificial Sequence: Synthetic polypeptide ABT2-10
EVQLLESGGGLVQPGGSLRLSCTASGFTFNRYNMAWARQAPGKGLEWVSEIDLKGSQTYYADSVKGRFTISRDNSKNTLYLQMNSLRAEDTAVYYCAKVSISAYHMFDYWGQGTLVTVSS

SEQ ID NO: 59 - protein, 122 aa, Artificial Sequence
  Description of Artificial Sequence: Synthetic polypeptide ABT2-108-504
EVQLLESGGGLVQPGGSLRLSCAASGFTFADEGMMWVRQAPGKGLEWVSRIGQDGKNTYYADSVKGRFTISRDNSKNTLYLQMNSLRAEDTAVYYCAKYTGRVGVHHLFDYWGQGTLVTVSS

SEQ ID NO: 60 - protein, 122 aa, Artificial Sequence
  Description of Artificial Sequence: Synthetic polypeptide ABT2-108-509
EVQLLESGGGLVQPGGSLRLSCAASGFTFAEYTMMWVRQAPGKGLEWVSRITYSGKNTYYADSVKGRFTISRDNSKNTLYLQMNSLRAEDTAVYYCAKYTGRVGVHHLFDYWGQGTLVTVSS

SEQ ID NO: 61 - protein, 122 aa, Artificial Sequence
  Description of Artificial Sequence: Synthetic polypeptide ABT2-108-511
EVQLLESGGGLVQPGGSLRLSCAASGFTFAEYTMMWVRQAPGKGLEWVSRIGQDGKNTVIRDSVKGRFTISRDNSKNTLYLQMNSLRAEDTAVYYCAKYTGRVGVHHLFDYWGQGTLVTVSS

SEQ ID NO: 62 - protein, 122 aa, Artificial Sequence
  Description of Artificial Sequence: Synthetic polypeptide ABT2-108-512(=611)
EVQLLESGGGLVQPGGSLRLSCAASGFTFAEYTMMWVRQAPGKGLEWVSRIGQDGKNTYVLRSVKGRFTISRDNSKNTLYLQMNSLRAEDTAVYYCAKYTGRVGVHHLFDYWGQGTLVTVSS

SEQ ID NO: 63 - protein, 122 aa, Artificial Sequence
  Description of Artificial Sequence: Synthetic polypeptide ABT2-108-518
EVQLLESGGGLVQPGGSLRLSCAASGFTFAEYTMMWVRQAPGKGLEWVSRIGQDGKNTYYRMDVKGRFTISRDNSKNTLYLQMNSLRAEDTAVYYCAKYTGRVGVHHLFDYWGQGTLVTVSS

SEQ ID NO: 64 - protein, 122 aa, Artificial Sequence
  Description of Artificial Sequence: Synthetic polypeptide ABT2-108-521
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRILGHHLFDYWGQGTLVTVSS

SEQ ID NO: 65 - protein, 122 aa, Artificial Sequence
  Description of Artificial Sequence: Synthetic polypeptide ABT2-108-524
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRVFNHHLFDYWGQGTLVTVSS

SEQ ID NO: 66 - protein, 122 aa, Artificial Sequence
  Description of Artificial Sequence: Synthetic polypeptide ABT2-108-527
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRVFKHHLFDYWGQGTLVTVSS

SEQ ID NO: 67 - protein, 122 aa, Artificial Sequence
  Description of Artificial Sequence: Synthetic polypeptide ABT2-108-533x
EVQLLESGGGLVQPGGSLRLSCAASGFTFADEGMMWVRQAPGKGLEWVSRIGQDGKNTYYADSVKGRFTISRDNSKNTLYLQMNSLRAEDTAVYYCAKYTGRILGHHLFDYWGQGTLVTVSS

SEQ ID NO: 68 - protein, 122 aa, Artificial Sequence
  Description of Artificial Sequence: Synthetic polypeptide ABT2-108-534x
EVQLLESGGGLVQPGGSLRLSCAASGFTFADEGMMWVRQAPGKGLEWVSRITYSGKNTYYADSVKGRFTISRDNSKNTLYLQMNSLRAEDTAVYYCAKYTGRIFSHHLFDYWGQGTLVTVSS

SEQ ID NO: 69 - protein, 122 aa, Artificial Sequence
  Description of Artificial Sequence: Synthetic polypeptide ABT2-108-537x
EVQLLESGGGLVQPGGSLRLSCAASGFTFADEGMMWVRQAPGKGLEWVSRIGQDGKNTYYRMDVKGRFTISRDNSKNTLYLQMNSLRAEDTAVYYCAKYTGRILGHHLFDYWGQGTLVTVSS

SEQ ID NO: 70 - protein, 122 aa, Artificial Sequence
  Description of Artificial Sequence: Synthetic polypeptide ABT2-108-538x
EVQLLESGGGLVQPGGSLRLSCAASGFTFADEGMMWVRQAPGKGLEWVSRITYSGKNTYYADSVKGRFTISRDNSKNTLYLQMNSLRAEDTAVYYCAKYTGRILGHHLFDYWGQGTLVTVSS

SEQ ID NO: 71 - protein, 122 aa, Artificial Sequence
  Description of Artificial Sequence: Synthetic polypeptide ABT2-108-601
EVQLLESGGGLVQPGGSLRLSCAASGFTFAEESWMWVRQAPGKGLEWVSRIGQDGKNTYYADSVKGRFTISRDNSKNTLYLQMNSLRAEDTAVYYCAKYTGRVGVHHLFDYWGQGTLVTVSS

SEQ ID NO: 72 - protein, 122 aa, Artificial Sequence
  Description of Artificial Sequence: Synthetic polypeptide ABT2-108-602
EVQLLESGGGLVQPGGSLRLSCAASGFTFAEEKYMWVRQAPGKGLEWVSRIGQDGKNTYYADSVKGRFTISRDNSKNTLYLQMNSLRAEDTAVYYCAKYTGRVGVHHLFDYWGQGTLVTVSS

SEQ ID NO: 73 - protein, 122 aa, Artificial Sequence
  Description of Artificial Sequence: Synthetic polypeptide ABT2-108-603
EVQLLESGGGLVQPGGSLRLSCAASGFTFAEYTMMWVRQAPGKGLEWVSRITDAGKNTYYADSVKGRFTISRDNSKNTLYLQMNSLRAEDTAVYYCAKYTGRVGVHHLFDYWGQGTLVTVSS

SEQ ID NO: 74 - protein, 122 aa, Artificial Sequence
  Description of Artificial Sequence: Synthetic polypeptide ABT2-108-604
EVQLLESGGGLVQPGGSLRLSCAASGFTFAEYTMMWVRQAPGKGLEWVSRVTYDGKNTYYADSVKGRFTISRDNSKNTLYLQMNSLRAEDTAVYYCAKYTGRVGVHHLFDYWGQGTLVTVSS

SEQ ID NO: 75 - protein, 122 aa, Artificial Sequence
  Description of Artificial Sequence: Synthetic polypeptide ABT2-108-605
EVQLLESGGGLVQPGGSLRLSCAASGFTFAEYTMMWVRQAPGKGLEWVSRIGQDGKNTYYREDVKGRFTISRDNSKNTLYLQMNSLRAEDTAVYYCAKYTGRVGVHHLFDYWGQGTLVTVSS

SEQ ID NO: 76 - protein, 122 aa, Artificial Sequence
  Description of Artificial Sequence: Synthetic polypeptide ABT2-108-606
EVQLLESGGGLVQPGGSLRLSCAASGFTFAEYTMMWVRQAPGKGLEWVSRIGQDGKNTYYRSSVKGRFTISRDNSKNTLYLQMNSLRAEDTAVYYCAKYTGRVGVHHLFDYWGQGTLVTVSS

SEQ ID NO: 77 - protein, 122 aa, Artificial Sequence
  Description of Artificial Sequence: Synthetic polypeptide ABT2-108-607
EVQLLESGGGLVQPGGSLRLSCAASGFTFAEYTMMWVRQAPGKGLEWVSRIGQDGKNTYYRSDVKGRFTISRDNSKNTLYLQMNSLRAEDTAVYYCAKYTGRVGVHHLFDYWGQGTLVTVSS

SEQ ID NO: 78 - protein, 122 aa, Artificial Sequence
  Description of Artificial Sequence: Synthetic polypeptide ABT2-108-612
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRIMGHHLFDYWGQGTLVTVSS

SEQ ID NO: 79 - protein, 122 aa, Artificial Sequence
  Description of Artificial Sequence: Synthetic polypeptide ABT2-108-613
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRVFEHHLFDYWGQGTLVTVSS

SEQ ID NO: 80 - protein, 122 aa, Artificial Sequence
  Description of Artificial Sequence: Synthetic polypeptide ABT2-108-617
EVQLLESGGGLVQPGGSLRLSCAASGFTFAEYTMMWVRQAPGKGLEWVSRIGQDGKNTYYADSVKGRFTISRDNSKNTLYLQMNSLRAEDTAVYYCAKYTGRIFTHHLFDYWGQGTLVTVSS

SEQ ID NO: 81 - protein, 122 aa, Artificial Sequence
  Description of Artificial Sequence: Synthetic polypeptide ABT2-108-620S
EVQLLESGGGLVQPGGSLRLSCAASGFTFSEESWMWVRQAPGKGLEWVSRIGQDGKNTYYREDVKGRFTISRDNSKNTLYLQMNSLRAEDTAVYYCAKYTGRIMGHHLFDYWGQGTLVTVSS

SEQ ID NO: 82 - protein, 122 aa, Artificial Sequence
  Description of Artificial Sequence: Synthetic polypeptide ABT2-108-620x
EVQLLESGGGLVQPGGSLRLSCAASGFTFAEESWMWVRQAPGKGLEWVSRIGQDGKNTYYREDVKGRFTISRDNSKNTLYLQMNSLRAEDTAVYYCAKYTGRIMGHHLFDYWGQGTLVTVSS

SEQ ID NO: 83 - protein, 123 aa, Artificial Sequence
  Description of Artificial Sequence: Synthetic polypeptide ABT2-65-166
EVQLLESGGGLVQPGGSLRLSCAASGFTFEDYQMGWVRQAPGKGLEWVSSISAMGGRTYYADSVKGRFTISRDNSKNTLYLQMNSLRAEDTAVYYCAQNLVRLGRSRWMFDYWGQGTLVTVSS

SEQ ID NO: 84 - protein, 123 aa, Artificial Sequence
  Description of Artificial Sequence: Synthetic polypeptide ABT2-65-166S
EVQLLESGGGLVQPGGSLRLSCAASGFTFSDYQMGWVRQAPGKGLEWVSSISAMGGRTYYADSVKGRFTISRDNSKNTLYLQMNSLRAEDTAVYYCAQNLVRLGRSRWMFDYWGQGTLVTVSS

SEQ ID NO: 85 - protein, 123 aa, Artificial Sequence
  Description of Artificial Sequence: Synthetic polypeptide ABT2-65-166SK
EVQLLESGGGLVQPGGSLRLSCAASGFTFSDYQMGWVRQAPGKGLEWVSSISAMGGRTYYADSVKGRFTISRDNSKNTLYLQMNSLRAEDTAVYYCAKNLVRLGRSRWMFDYWGQGTLVTVSS

SEQ ID NO: 86 - protein, 123 aa, Artificial Sequence
  Description of Artificial Sequence: Synthetic polypeptide ABT2-65-17
EVQLLESGGGLVQPGGSLRLSCVASGFTFEDYQMGWVRQAPGKGLEWVSSISAMGNRTYYADSVKGRFTISRDDSKNTLYLQMNSLRAEDTAVYYCAQNLVRLGRSRWMFDYWGQGTLVTVSS

SEQ ID NO: 87 - protein, 123 aa, Artificial Sequence
  Description of Artificial Sequence: Synthetic polypeptide ABT2-65-201
EVQLLESGGGLVQPGGSLRLSCVASGFTFEDYQMGWVRQAPGKGLEWVSSISAMGRRTYYADSVKGRFTISRDNSKNTLYLQMNSLRAEDTAVYYCAQNLVRLGRSRWMFDYWGQGTLVTVSS

SEQ ID NO: 88 - protein, 123 aa, Artificial Sequence
  Description of Artificial Sequence: Synthetic polypeptide ABT2-65-203
EVQLLESGGGLVQPGGSLRLSCVASGFTFEDYQMGWVRQAPGKGLEWVSSISAMGFRTYYADSVKGRFTISRDNSKNTLYLQMNSLRAEDTAVYYCAQNLVRLGRSRWMFDYWGQGTLVTVSS

SEQ ID NO: 89 - protein, 123 aa, Artificial Sequence
  Description of Artificial Sequence: Synthetic polypeptide ABT2-65-8
EVQLLESGGGLVQPGGSLRLSCAASGFTFEDYQMGWVRQAPGKGLEWVSSISAMGNRTYYADSVKGRFTISRDDSKNTLYLQMNSLRAEDTAVYYCAQNLVRMDSRRWMFDYWGQGTLVTVSS

SEQ ID NO: 90 - protein, 123 aa, Artificial Sequence
  Description of Artificial Sequence: Synthetic polypeptide ABT2-65-B1
EVQLLESGGGLVQPGGSLRLSCVASGFTFEDYQMGWVRQAPGKGLEWVSSISAMGGRTYYADSVKGRFTISRDDSKNTLYLQMNSLRAEDTAVYYCAQNLVRLGRSRWMFDYWGQGTLVTVSS

SEQ ID NO: 91 - protein, 123 aa, Artificial Sequence
  Description of Artificial Sequence: Synthetic polypeptide ABT2-65-B2
EVQLLESGGGLVQPGGSLRLSCVASGFTFEDYQMGWVRQAPGKGLEWVSSISAMGRRTYYADSVKGRFTISRDDSKNTLYLQMNSLRAEDTAVYYCAQNLVRLGRSRWMFDYWGQGTLVTVSS

SEQ ID NO: 92 - protein, 123 aa, Artificial Sequence
  Description of Artificial Sequence: Synthetic polypeptide ABT2-65-B3
EVQLLESGGGLVQPGGSLRLSCVASGFTFEDYQMGWVRQAPGKGLEWVSSISAMGNRAYYADSVKGRFTISRDDSKNTLYLQMNSLRAEDTAVYYCAQNLVRLGRSRWMFDYWGQGTLVTVSS

SEQ ID NO: 93 - protein, 108 aa, Artificial Sequence
  Description of Artificial Sequence: Synthetic polypeptide Vk Dummy
DIQMTQSPSSLSASVGDRVTITCRASQSISSYLNWYQQKPGKAPKLLIYAASSLQSGVPSRFSGSGSGTDFTLTISSLQPEDFATYYCQQSYSTPNTFGQGTKVEIKR

SEQ ID NO: 94 - protein, 108 aa, Artificial Sequence
  Description of Artificial Sequence: Synthetic polypeptide ABT1-122-505
DIQMTQSPSSLSASVGDRVTITCRASQPIWTELNWYQQKPGKAPKLLIYGSSSLQSGVPSRFSGSGSGTDFTLTISSLQPEDFATYYCKQFAYFPATFGQGTKVEIKR

SEQ ID NO: 95 - protein, 108 aa, Artificial Sequence
  Description of Artificial Sequence: Synthetic polypeptide ABT1-122-508
DIQMTQSPSSLSASVGDRVTITCRASQPIWTELNWYQQKPGKAPKLLIYGSSSLQRGVPSRFSGSGSGTDFTLTISSLQPEDFATYYCQQFAYFPATFGQGTKVEIKR

SEQ ID NO: 96 - protein, 108 aa, Artificial Sequence
  Description of Artificial Sequence: Synthetic polypeptide ABT1-122-510
DIQMTQSPSSLSASVGDRVTITCRFSYPIWTELNWYQQKPGKAPKLLIYGSSSLQSGVPSRFSGSGSGTDFTLTISSLQPEDFATYYCQQFAYFPATFGQGTKVEIKR

SEQ ID NO: 97 - protein, 108 aa, Artificial Sequence
  Description of Artificial Sequence: Synthetic polypeptide ABT1-122-511
DIQMTQSPSSLSASVGDRVTITCRASQPIWTELNWYQQKPGKAPKLLIYGSSSLQRGVPSRFSGSGSGTDFTLTISSLQPEDFATYYCKQFAYFPATFGQGTKVEIKR

SEQ ID NO: 98 - protein, 108 aa, Artificial Sequence
  Description of Artificial Sequence: Synthetic polypeptide ABT1-122-512
DIQMTQSPSSLSASVGDRVTITCRASQPIWTELNWYQQKPGKAPKLLIYGSAKRQRGVPSRFSGSGSGTDFTLTISSLQPEDFATYYCKQFAYFPATFGQGTKVEIKR

SEQ ID NO: 99 - protein, 108 aa, Artificial Sequence
  Description of Artificial Sequence: Synthetic polypeptide ABT1-122-513
DIQMTQSPSSLSASVGDRVTITCRASQPIWTELNWYQQKPGKAPKLLIYGSGSRQRGVPSRFSGSGSGTDFTLTISSLQPEDFATYYCKQFAYFPATFGQGTKVEIKR

SEQ ID NO: 100 - protein, 108 aa, Artificial Sequence
  Description of Artificial Sequence: Synthetic polypeptide ABT1-122-551
DIQMTQSPSSLSASVGDRVTITCRAKFNIWTELNWYQQKPGKTPKLLIYGSSSLQSGVPSRFSGSGSGTDFTLTISSLQPEDFATYYCQQFAYFPATFGQGTKVEIKR

SEQ ID NO: 101 - protein, 108 aa, Artificial Sequence
  Description of Artificial Sequence: Synthetic polypeptide ABT1-122-552
DIQMTQSPSSLSASVGDRVTITCRASLGVWTELNWYQQKPGKAPKLLIYGSSSLQSGVPSRFSGSGSGTDFTLTISSLQPEDFATYYCQQFAYFPATFGQGTKVEIKR

SEQ ID NO: 102 - protein, 108 aa, Artificial Sequence
  Description of Artificial Sequence: Synthetic polypeptide ABT1-122-553
DIQMTQSPSSLSASVGDRVTITCRASQPIWTELKWYQQKPGKAPKLLIYGSSSLQSGVPSRFSGSGSGTDFTLTISSLQPEDFATYYCQQFAYFPATFGQGTKVEIKR

SEQ ID NO: 103 - protein, 108 aa, Artificial Sequence
  Description of Artificial Sequence: Synthetic polypeptide ABT1-122-554
DIQMTQSPSSLSASVGDRVTITCRASQPIWTELNWYQQKPGKAPKLLIYGSSSLQSGVPSRFSGSGSGTDFTLTISSLQPEDFATYYCQQFAYFPATFGQETKVEIKR

SEQ ID NO: 104 - protein, 108 aa, Artificial Sequence
  Description of Artificial Sequence: Synthetic polypeptide ABT1-122-555
DIQMTQSPSSLSASVGDRVTITCRASQPIWTELNWYQQKPGKTPKLLIYGSSSLQSGVPSRFSGSGSGTDFTLTISSLQPEDFATYYCQQFAYFPATFGQGTKVEIKR

SEQ ID NO: 105 - protein, 108 aa, Artificial Sequence
  Description of Artificial Sequence: Synthetic polypeptide ABT1-122-556
DIQMTQSPSSLSASVGDRVTITCRASQPIWTELNWYQQKPGKAPKLLIYGSSSLQSGVPSRFSGSGSGTDFTLTISSLQPEDFATYHCQQFAYFPATFGQGTKVEIKR

SEQ ID NO: 106 - protein, 108 aa, Artificial Sequence
  Description of Artificial Sequence: Synthetic polypeptide ABT1-122-557
DIQMTQSPSSLSASVGDRVTITCRASQPIWTELNWYQQKPGKAPKLLIYGSSSLQSGVPSRFSGSGSGTDFTLTISSLQPEDFATYYCQQFAYFPATLGQGTKVEIKR

SEQ ID NO: 107 - protein, 108 aa, Artificial Sequence
  Description of Artificial Sequence: Synthetic polypeptide ABT1-122-750M
DIQMTQSPSSLSASVGDRVTITCSASQHIWTEMSWYQQKPGKAPKLLIYGSASRQKGVPSRFSGSGSGTDFTLTISSLQPEDFATYYCKQFAYFPNTFGQGTKVEIKR

SEQ ID NO: 108 - protein, 108 aa, Artificial Sequence
  Description of Artificial Sequence: Synthetic polypeptide ABT1-122-750MH
DIQMTQSPSSLSASVGDRVTITCSASQHIWTEMSWYQQKPGKAPKLLIYGSASRQKGVPSRFSGSGSGTDFTLTISSLQPEDFATYHCKQFAYFPNTFGQGTKVEIKR

SEQ ID NO: 109 - protein, 108 aa, Artificial Sequence
  Description of Artificial Sequence: Synthetic polypeptide ABT1-122-750MT
DIQMTQSPSSLSASVGDRVTITCSASQHIWTEMSWYQQKPGKTPKLLIYGSASRQKGVPSRFSGSGSGTDFTLTISSLQPEDFATYYCKQFAYFPNTFGQGTKVEIKR

SEQ ID NO: 110 - protein, 108 aa, Artificial Sequence
  Description of Artificial Sequence: Synthetic polypeptide ABT1-122-750T
DIQMTQSPSSLSASVGDRVTITCSASQHIWTEISWYQQKPGKAPKLLIYGSASRQKGVPSRFSGSGSGTDFTLTISSLQPEDFATYYCKQFAYFPNTFGQGTKVEIKR

SEQ ID NO: 111 - protein, 108 aa, Artificial Sequence
  Description of Artificial Sequence: Synthetic polypeptide ABT1-122-750x
DIQMTQSPSSLSASVGDRVAITCSASQHIWTEISWYQQKPGKAPKLLIYGSASRQKGVPSRFSGSGSGTDFTLTISSLQPEDFATYYCKQFAYFPNTFGQGTKVEIKR

SEQ ID NO: 112 - protein, 108 aa, Artificial Sequence
  Description of Artificial Sequence: Synthetic polypeptide ABT1-122-750xH
DIQMTQSPSSLSASVGDRVAITCSASQHIWTEISWYQQKPGKAPKLLIYGSASRQKGVPSRFSGSGSGTDFTLTISSLQPEDFATYHCKQFAYFPNTFGQGTKVEIKR

SEQ ID NO: 113 - protein, 108 aa, Artificial Sequence
  Description of Artificial Sequence: Synthetic polypeptide ABT1-141-25
DIQMTQSPSSLSASVGDRVTITCRASQWIQKQLAWYQQKPGKAPKLLIYSSSYLQSGVPSRFSGSGSGTDFTLTISSLQPEDFATYYCQQHLRVPMTFGQGTKVEIKR

SEQ ID NO: 114 - protein, 108 aa, Artificial Sequence
  Description of Artificial Sequence: Synthetic polypeptide ABT1-141-29
DIQVTQSPSSLSASVGDRVTITCRASQWIQKQLAWYQLKPGKAPKLLIYSSSYLQSGVPSRFSGSGSGTDFTLTISSLQPEDFATYYCQQHLRVPFTFGQGTKVEIKR

SEQ ID NO: 115 - protein, 108 aa, Artificial Sequence
  Description of Artificial Sequence: Synthetic polypeptide ABT1-18
DIQMTQSPSSLSASVGDRVTITCRASQSIQRWLAWYQQKPGKAPKLLIYFASQLQSGVPSRFSGSGSGTDFTLTISSLQPEDFATYYCQQLLRLPKTFGQGTKVEIKR

SEQ ID NO: 116 - protein, 108 aa, Artificial Sequence
  Description of Artificial Sequence: Synthetic polypeptide ABT1-212
DIQMTQSPSSLSASVGDRVTITCRASQRINGNLRWYQQKPGKAPKLLIYSVSQLQSGVPSRFSGSGSGTDFTLTISSLQPEDFATYYCQQGYDWPPTFGQGTKVETKR

SEQ ID NO: 117 - protein, 108 aa, Artificial Sequence
  Description of Artificial Sequence: Synthetic polypeptide ABT1-221
DIQMTQSPSSLSASVGDRVTITCRASQDIWPYLMWYQQKPGKAPKLLIYYSSMLQSGVPSRFSGSGSGTDFTLTISSLQPEDFATYYCQQFRRWPYTFGQGTKVEIKR

SEQ ID NO: 118 - protein, 108 aa, Artificial Sequence
  Description of Artificial Sequence: Synthetic polypeptide ABT1-222
DIQMTQSPSSLSASVGDRVTITCRASQPITRNLRWYQQKPGKAPKLLIYHSSVLQSGVPSRFSGSGSGTDFTLTISSLQPEDFATYYCQQGYRWPVTFGQGTKVEIKR

SEQ ID NO: 119 - protein, 108 aa, Artificial Sequence
  Description of Artificial Sequence: Synthetic polypeptide ABT1-3
DIQMTQSPSSLSASVGDRVTITCRASQSIWTELKWYQQKPGKAPKLLIYGASLLQSGVPSRFSGSGSGTDFTLTISSLQPEDFATYYCQQFAYFPFTFGQGTKVEIKR

SEQ ID NO: 120 - protein, 108 aa, Artificial Sequence
  Description of Artificial Sequence: Synthetic polypeptide ABT1-9
DIQMTQSPSSLSASVGDRVTITCRASQSIGSSLLWYQQKPGKAPKLLIYLASRLQSGVPSRFSGSGSGTDFTLTISSLQPEDFATYYCQQFRSTPNTFGQGTKVEIKR

SEQ ID NO: 121 - protein, 108 aa, Artificial Sequence
  Description of Artificial Sequence: Synthetic polypeptide ABT1-95-15
DIQMTQSPSSLSASVGDRVTITCRASQPIVRNLRWYQQKPGKAPKLLIYSSSYLEPGVPSRFSGSGSGTDFTLTISSLQPEDFATYHCQQGYRWPVTFGQGTKVEIKR

SEQ ID NO: 122 - protein, 108 aa, Artificial Sequence
  Description of Artificial Sequence: Synthetic polypeptide ABT1-95-174
DIQMTQSPSSLSASVGDRVTITCRASRPIVRNLRWYQQKPGKAPKLLIYSVSYLEPGVPSRFSGSGSGTDFTLTISSLQPEDFATYHCRQGYRWPVTFGQGTKVEIKR

SEQ ID NO: 123 - protein, 108 aa, Artificial Sequence
  Description of Artificial Sequence: Synthetic polypeptide ABT1-95-177
DIQMTQSPSSLSASVGDRVTITCRASQPIVRNLRWYQQKPGKAPKLLIYASSYLEPGVPSRFSGSGSGTDFTLTISSLQPEDFATYHCRQGYRWPVTFGQGTKVEIKR

SEQ ID NO: 124 - protein, 108 aa, Artificial Sequence
  Description of Artificial Sequence: Synthetic polypeptide ABT1-95-181
DIQMTQSPSSLSASVGDRVTITCRASKPIVRNMRWYQQKPGKAPKLLIYSVSYLEPGVPSRFSGSGSGTDFTLTISSLQPEDFATYHCLQGYRWPPTFGQGTKVEIKR

SEQ ID NO: 125 - protein, 108 aa, Artificial Sequence
  Description of Artificial Sequence: Synthetic polypeptide ABT1-95-182
DIQMTQSPSSLSASVGDRVTITCRASKPGVRNLRWYQQKPGKAPKLLIYSVSYLEPGVPSRFSGSGSGTDFTLTISSLQPEDFATYHCLQGYRWPPTFGQGTKVEIKR

SEQ ID NO: 126 - protein, 108 aa, Artificial Sequence
  Description of Artificial Sequence: Synthetic polypeptide ABT1-95-184
DIQMTQSPSSLSASVGDRVTITCRASRTPVRNLRWYQQKPGKAPKLLIYSRSYLEPGVPSRFSGSGSGTDFTLTISSLQPEDFATYHCLQGYRWPPTFGQGTKVEIKR

SEQ ID NO: 127 - protein, 108 aa, Artificial Sequence
  Description of Artificial Sequence: Synthetic polypeptide ABT1-95-3
DIQMTQSPSSLSASVGDRVTITCRASQPIHGNLRWYQQKPGKAPKLLIYSSSYLQSGVPSRFSGSGSGTDFTLTISSLQPEDFATYHCQQGYRWPVTFGQGTKVEIKR

SEQ ID NO: 128 - protein, 108 aa, Artificial Sequence
  Description of Artificial Sequence: Synthetic polypeptide ABT1-95-A1
DIQMTQSPSSLSASVGDRVTITCRASRPGVRNLRWYQQKPGKAPKLLIYHVSDLEPGVPSRFSGSGSGTDFTLTISSLQPEDFATYHCRQGYVWPVPFDQGTKVEIKR

SEQ ID NO: 129 - protein, 108 aa, Artificial Sequence
  Description of Artificial Sequence: Synthetic polypeptide ABT1-95-A2
DIQMTQSPSSLSASVGDRVTITCRILQPPGRNLRWYQQKPGKAPKLLIYSKSFLEPGVPSRFSGSGSGTDFTLTISSLQPEDFATYHCQQGYRWPVTFGQGTKVEIKR

SEQ ID NO: 130 - protein, 108 aa, Artificial Sequence
  Description of Artificial Sequence: Synthetic polypeptide ABT1-95-A3
DIQMTQSPSSLSASVGDRVTITCRASKPGVRNMRWYQQKPGKAPKLLIYSVSYLEPGVPSRFSGSGSGTDFTLTISSLQPEDFATYHCLQGYRWPPTFGQGTKVEIKR

SEQ ID NO: 131 - protein, 108 aa, Artificial Sequence
  Description of Artificial Sequence: Synthetic polypeptide ABT1-95-A4
DIQMTQSPSSLSASVGDRVTITCRASRPGVRNLRWYQQKPGKAPKLLIYSRSFLEPGVPSRFSGSGSGTDFTLTISSLQPEDFATYHCLQGYRWPPTFGQGTKVEIKR

SEQ ID NO: 132 - protein, 108 aa, Artificial Sequence
  Description of Artificial Sequence: Synthetic polypeptide ABT1-95-A5
DIQMTQSPSSLSASVGDRVTITCRASRTPVRNLRWYQQKPGKAPKLLIYSRSFLEPGVPSRFSGSGSGTDFTLTISSLQPEDFATYHCLQGYRWPPTFGQGTKVEIKR

SEQ ID NO: 133 - protein, 108 aa, Artificial Sequence
  Description of Artificial Sequence: Synthetic polypeptide ABT1-95-A6
DIQMTQSPSSLSASVGDRVTITCRASKPGVRNMRWYQQKPGKAPKLLIYAKSYLEPGVPSRFSGSGSGTDFTLTISSLQPEDFATYHCKQGYRWPVQFGQGTKVEIKR

SEQ ID NO: 134 - DNA, 348 bp, Artificial Sequence
  Description of Artificial Sequence: Synthetic polynucleotide ABT1-6
gaggtgcagctgttggagtctgggggaggcttggtacagcctggggggtccctgcgtctctcctgtgcagcctccggattcacctttggggcttatgatatgcagtgggtccgccaggctccagggaagggtctagagtgggtctcaagtattaataagtctggtgctttgacatcttacgcagactccgtgaagggccggttcaccatctcccgcgacaattccaagaacacgctgtatctgcaaatgaacagcctgcgtgccgaggacaccgcggtatattactgtgcgaaaggttgggcgtcttttgactactggggccagggaaccctggtcaccgtctcgagc

SEQ ID NO: 135 - DNA, 348 bp, Artificial Sequence
  Description of Artificial Sequence: Synthetic polynucleotide ABT1-6-3
gaggtgcagctgttggagtctgggggaggcttggtacagcctggggggtccctgcgtctctcctgtgcagcctccggattcacctttggggcttatgatatgcagtgggtccgccaggctccaggcaagggtctagagtgggtctcaagtatttataagtctggtgctttgacatcttacgcagactccgtgaagggccggttcaccatctcccgcgacaattccaagaacacgctgtatctgcaaatgaacagcctgcgtgccgaggacaccgcggtatattactgtgcgaaaggttgggcgtcttttgactactggggccagggaaccctggtcaccgtctcgagc

SEQ ID NO: 136 - DNA, 348 bp, Artificial Sequence
  Description of Artificial Sequence: Synthetic polynucleotide ABT1-6-23
gaggtgcagctgttggagtctgggggaggcttggtacagcctggggggtccctgcgtctctcctgtgcagcctccggattcacctttgtacgctatgacatggcatgggtccgccaggctccagggaagggtctagagtgggtctcaagtatttataagtctggtgctttgacatcttacgcagactccgtgaagggccggttcaccatctcccgcgacaattccaagaacacgctgtatctgcaaatgaacagcctgcgtgccgaggacaccgcggtatattactgtgcgaaaggttgggcgtcttttgactactggggccagggaaccctggtcaccgtctcgagc

SEQ ID NO: 137 - DNA, 360 bp, Artificial Sequence
  Description of Artificial Sequence: Synthetic polynucleotide ABT1-7
gaggtgcagctgttggagtctgggggaggcttggtacagcctggggggtccctgcgtctctcctgtgcagcctccggattcacctttaggcggtatcggatgcagtgggtccgccaggctccagggaagggtctagagtgggtctcatctattagttgggagggtacgaggacactttacgcagactccgtgaagggccggttcaccatctcccgcgacaattccaagaacacgctgtatctgcaaatgaacagcctgcgtgccgaggacaccgcggtatattactgtgcgaaagtgactcagaagggtttgttgaattttgactactggggccagggaaccctggtcaccgtctcgagc

SEQ ID NO: 138 - DNA, 360 bp, Artificial Sequence
  Description of Artificial Sequence: Synthetic polynucleotide ABT1-8
gaggtgcagctgttggagtctgggggaggcttggtacagcctggggggtccctgcgtctctcctgtgcagcctccggattcacccttaaggcgtataatatgtcgtgggtccgccaggctccagggaagggtctagagtgggtctcactgattagtagtacgggtatgtttacagattacgcagactccgtgaagggccggttcaccatctcccgcgacaattccaagaacacgctgtatctgcaaatgaacagcctgcgtgccgaggacaccgcggtatattactgtgcgaaatggggggttaggcgggggctttattttgactactggggccagggaaccctggtcaccgtctcgagc

SEQ ID NO: 139 - DNA, 348 bp, Artificial Sequence
  Description of Artificial Sequence: Synthetic polynucleotide ABT1-15
gaggtgcagctgttggagtctgggggaggcttggtacagcctggggggtccctgcgtctctcctgtgcagcctccggattcacctttgggcggtatcggatgcagtgggtccgccaggctccagggaagggtctagagtgggtctcaagtattaataagtctggtgctttgacatcttacgcagactccgtgaagggccggttcaccatctcccgcgacaattccaagaacacgctgtatctgcaaatgaacagcctgcgtgccgaggacaccgcggtatattactgtgcgaaaggttgggcgtcttttgactactggggccagggaaccctggtcaccgtctcgagc

SEQ ID NO: 140 - DNA, 360 bp, Artificial Sequence
  Description of Artificial Sequence: Synthetic polynucleotide ABT1-17
gaggtgcagctgttggagtctgggggaggcttggtacagcctggggggtccctgcgtctctcctgtgcagcctccggattcacctttaggcggtatcggatgccgtgggtccgccaggctccagggaagggtctagagtgggtctcatctattagttgggagggtacgaggacactttacgcagactccgtgaagggccggttcaccatctcccgcgacaattccaagaacacgctgtatctgcaaatgaacagcctgcgtgccgaggacaccgcggtatattactgtgcgaaagtgactcaaaagggtttgctgaattttgactactggggccagggaaccctggtcaccgtctcgagc

SEQ ID NO: 141 - DNA, 348 bp, Artificial Sequence
  Description of Artificial Sequence: Synthetic polynucleotide ABT1-19
gaggtgcagctgttggagtctgggggaggcttggtacagcctggggggtccctgcgtctctcctgtgcagcctccggattcacctttcctgtttatagtatgccttgggtccgccaggctccagggaagggtctagagtgggtctcactgattccgtggcctggtttgagtacatactacgcagactccgtgaagggccggttcaccatctcccgcgacaattccaagaacacgctgtatctgcaaatgaacagcctgcgtgccgaggacaccgcggtatattactgtgcgaaagagacgtctaattttgactactggggtcagggaaccctggtcaccgtctcgagc

SEQ ID NO: 142 - DNA, 348 bp, Artificial Sequence
  Description of Artificial Sequence: Synthetic polynucleotide ABT1-20
gaggtgcagctgttggagactgggggaggcttggtacagcctggggggtccctgcgtctctcctgtgcagcctccggattcacctttacgccttatcggatggggtgggtccgccaggctccagggaagggtctagagtgggtctcacatattgggatttggggtgctaatacatactacgcagactccgtgaagggccggttcaccatctcccgcgacaattccaagaacacgctgtatctgcaaatgaacagcctgcgcgccgaggacaccgcggtatattactgtgcgaaacatccgaggccttttgactactggggtcagggaaccctggtcaccgtctcgagc

SEQ ID NO: 143 - DNA, 348 bp, Artificial Sequence
  Description of Artificial Sequence: Synthetic polynucleotide ABT1-21
gaggtgcagctgttggagtctgggggaggcttggtacagcctggggggtccctgcgtctctcctgtgcagcctccggattcacctttaggccgtatgcgatgacttgggtccgccaggctccagggaagggtctagagtgggtctcaactattgggcggacgggtactcgtacatactacgcagactccgtgaagggccggttcaccatctcccgcgacaattccaagaacacgctgtatctgcaaatgaacagcctgcgtgccgaggacaccgcggtatattactgtgcgaaagggcggcggaggtttgactactggggtcagggaaccctggtcaccgtctcgagc

SEQ ID NO: 144 - DNA, 360 bp, Artificial Sequence; identical to SEQ ID NO: 138
  Description of Artificial Sequence: Synthetic polynucleotide ABT1-22

SEQ ID NO: 145 - DNA, 348 bp, Artificial Sequence
  Description of Artificial Sequence: Synthetic polynucleotide ABT1-23
gaggtgcagctgttggagtctgggggaggcttggtacagcctggggggtccctgcgtctctcctgtgcagcctccggattcaccttttcgtcgtatcctatggagtgggtccgccaggctccagggaagggtctagagtgggtctcagcgattgcgtggccgggtagtatgacatactacgcagactccgtgaagggccggttcaccatctcccgcgacaattccaagaacacgctgtatctgcaaatgaacagcctgcgtgccgaggacaccgcggtatattactgtgcgaaaacgcatcggctttttgactactggggtcagggaaccctggtcaccgtctcgagc

SEQ ID NO: 146 - DNA, 348 bp, Artificial Sequence
  Description of Artificial Sequence: Synthetic polynucleotide ABT1-31
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcaggtattaatcggtctggtacgcgtacatactacgcagactccgtgaagggccggttcaccatctcccgcgacaattccaagaacacgctgtatctgcaaatgaacagcctgcgtgccgaggacaccgcggtatattactgtgcgaaaaggattcgtcattttgactactggggtcagggaaccctggtcaccgtctcgagc

SEQ ID NO: 147 - DNA, 360 bp, Artificial Sequence
  Description of Artificial Sequence: Synthetic polynucleotide ABT1-32
gaggtgcagctgttggagtctgggggaggcttggtacagcctggggggtccctgcgtctctcctgtgcagcctccggattcacctttcctgattatgatatgaagtgggtccgccaggctccagggaagggtctagagtgggtctcagctattagtggtagtggtggtagcacatactacgcagactccgtgaagggccggttcaccatctcccgcgacaactccaagaacacgctgtatctgcaaatgaacagcctgcgtgccgaggacaccgctgtatattactgtgcgaaaattgttggttttgcgtgggattattttgactactggggccagggaaccctggtcaccgtctcgagc

SEQ ID NO: 148 - DNA, 360 bp, Artificial Sequence
  Description of Artificial Sequence: Synthetic polynucleotide ABT1-33
gaggtgcagctgttggagtctgggggaggcttggtacagcctggggggtccctgcgtctctcctgtgcagcctccggatacacctttaggagttatagtatgaattgggtccgccaggctccagggaagggtctagagtgggtctcagcgattagtccgcatggtacgtatacaaagtacgcagactccgtgaagggccggttcaccatctcccgcgacaattccaagaacacgctgtatctgcaaatgaacagcctgcgtgccgaggacaccgcggtatattactgtgcgaaacggcgtattcgttcttcgggtttttttgactactggggccagggaaccctggtcaccgtctcgagc

SEQ ID NO: 149 - DNA, 360 bp, Artificial Sequence
  Description of Artificial Sequence: Synthetic polynucleotide ABT1-34
gaggtgcagctgttggagtctgggggaggcttggtacagcctggggggtccctgcgtctctcctgtgcagcctccggattcacctttgctaggtattcgatgagttgggtccgccaggctccagggaagggtctagagtgggtctcaatgattgctcctgcgggtaggatgacattgtacgcagactccgtgaagggccggttcaccatctcccgcgacaattccaagaacacgctgtatctgcaaatgaacagcctgcgtgccgaggacaccgcggtatattactgtgcgaaaacgggtttgactcggaggacgcggtttgactactggggccagggaaccctggtcaccgtctcgagc

SEQ ID NO: 150 - DNA, 360 bp, Artificial Sequence
  Description of Artificial Sequence: Synthetic polynucleotide ABT1-35
gaggtgcagctgttggagtctgggggaggcttggtacagcctggggggtccctgcgtctctcctgtgcagcctccggattcacctttaagttgtatgagatggagtgggtccgccaggctccagggaagggtctagagtgggtctcacggattgatagtatgggtgggattacagagtacgcagactccgtgaagggccggttcaccatctcccgcgacaattccaagaacacgctgtatctgcaaatgaacagcctgcgtgccgaggacaccgcggtatattactgtgcgaaaactgagcttccttatccttcggcttttgactactggggccagggaaccctggtcaccgtctcgagc

SEQ ID NO: 151 - DNA, 348 bp, Artificial Sequence
  Description of Artificial Sequence: Synthetic polynucleotide ABT1-36
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcatctatttcgtcgggtggtagtgctacagcgtacgcagactccgtgatgggccggttcaccatctcccgcgacaattccaagaacacgctgtatctgcaaatgaacagcctgcgtgccgaggacgccgcggtatattactgtgcgaaaaggtcttatctgtttgactactggggccagggaaccctggtcaccgtctcgagc

SEQ ID NO: 152 - DNA, 348 bp, Artificial Sequence
  Description of Artificial Sequence: Synthetic polynucleotide ABT1-37
gaggtgcagctgttggagtctgggggaggcttggtacagcctggggggtccctgcgtctctcctgtgcagcctccggattcacctttcatgattatgatatgaagtgggtccgccaggctccagggaagggtctagagtgggtctcatggatttcgtttgatggtgctcggacattttacgcagactccgtgcagggccggttcaccatctcccgcgacaattccaagaacacgctgtatctgcaaatgaacagcctgcgtgccgaggacaccgcggtatattactgtgcgaaagaggagacgggttttgactactggggccagggaaccctggtcaccgtctcgagc

SEQ ID NO: 153 - DNA, 348 bp, Artificial Sequence
  Description of Artificial Sequence: Synthetic polynucleotide ABT1-38
gaggtgcagctgttggagtctgggggaggcttggtacagcctggggggtccctgcgtctctcctgtgcagcctccggattcacctttaggcagtatcggatggggtgggtccgccaggctccagggaggggtctagagtgggtctcacggattgagagtgatggtgcggagacatcttacgcagactccgtgaagggccggttcaccatctcccgcgacaattccaagaacacgctgtatctgcaaatgaacagcctgcgtgccgaggacaccgcggtatattactgtgcgaaacctgattggatttttgactacaggggccagggaaccctggtcaccgtctcgagc

SEQ ID NO: 154 - DNA, 360 bp, Artificial Sequence
  Description of Artificial Sequence: Synthetic polynucleotide ABT1-40
gaggtgcagctgttggagtctgggggaggcttggtacagcctggggggtccctgcgtctctcctgtgcagcctccggattcacctttcctatttattttatggtttgggtccgccaggctccagggaagggtctagagtgggtctcactgattagtagtacgggtatgtttacagattacgcagactccgtgaagggccggttcaccatctcccgcgacaattccaagaacacgctgtatctgcaaatgaacagcctgcgtgccgaggacaccgcggtatattactgtgcgaaatggggggttaggcgggggctttattttgactactggggccagggaaccctggtcaccgtctcgagc

SEQ ID NO: 155 - DNA, 360 bp, Artificial Sequence
  Description of Artificial Sequence: Synthetic polynucleotide ABT1-41
gaggtgcagctgttggagtctgggggaggcttggtacagcctggggggtccctgcgtctctcctgtgcagcctccggattcacctttcagtattatgttatgggttgggtccgccaggctccagggaagggtctagagtgggtctcatggattgctacgtatggtagtcatacatggtacgcagactccgtgaagggccggttcaccatctcccgcgacaattccaagaacacgctgtatctgcaaatgaacagcctgcgtgccgaggacaccgcggtatattactgtgcgaaacagggtaatcatcgtttgggtcattttgactactggggccagggaaccctggtcaccgtctcgagc

SEQ ID NO: 156 - DNA, 360 bp, Artificial Sequence
  Description of Artificial Sequence: Synthetic polynucleotide ABT1-42
gaggtgcagctgttggagtctgggggaggcttggtacagcctggggggtccctgcgtctctcctgtgcagcctccggattcacctttgagaagtatgagatggcgtgggtccgccaggctccagggaagggtctagagtgggtctcagctattgggcctatgggttttggtacaaattacgcagactccgtgaagggccggttcaccatctcccgcgacaattccaagaacacgctgtatctgcaaatgaacagcctgcgtgccgaggacaccgcggtatattactgtgcgaaatttgggaagcatcctccgggtacttttgactactggggccagggaaccctggtcaccgtctcgagc

SEQ ID NO: 157 - DNA, 360 bp, Artificial Sequence
  Description of Artificial Sequence: Synthetic polynucleotide ABT1-43
gaggtgcagctgttggagtctgggggaggcttggtacagcctggggggtccctgcgtctctcctgtgcagcctccggattcacctttgagaagtatgagatggcgtgggtccgccaggctccagggaagggtctagagtgggtctcagctattgggcctatgggttttggtacaaattacgcagactccgtgaagggccggttcaccatctcccgcgacaattccaagaacacgctgtatctgcaaatgaacagcctgcgtgccgaggacaccgcggtatattactgtgcgaaatttgggaagcatcctcagggtacttttgactactggggccagggaaccctggtcaccgtctcgagc

SEQ ID NO: 158 - DNA, 360 bp, Artificial Sequence
  Description of Artificial Sequence: Synthetic polynucleotide ABT1-45
gaggtgcagctgttggagtctgggggaggcttggtacagcctggggggtccctgcgcctctcctgtgcagcctccggattcacctttcataattataggatgttgtgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaatcggcgcctattccgatgagtatgtttgactactggggccagggaaccctggtcaccgtctcgagc

SEQ ID NO: 159 - DNA, 360 bp, Artificial Sequence
  Description of Artificial Sequence: Synthetic polynucleotide ABT1-46
gaggtgcagctgttggagtctgggggaggcttggtacagcctggggggtccctgcgtctctcctgtgcagcctccggattcacctttgggaattatatgatggattgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaactggggcatccgatgggtaatggttttgactactggggccagggaaccctggtcaccgtctcgagc

SEQ ID NO: 160 - DNA, 348 bp, Artificial Sequence
  Description of Artificial Sequence: Synthetic polynucleotide ABT1-47
gaggtgcagctgttggagtctgggggaggcttggtacagcctggggggtccctgcgtctctcctgtgcagcctccggattcacctttggggcttatgatatgcactgggtccgccaggctccagggaagggtctagagtgggtctcatgtattaataagtctggtgctttgacatcttacgcagactccgtgaagggccggttcaccatctcccgcgacaattccaagaacacgctgtatctgcaaatgaacagcctgcgtgccgaggacaccgcggtatattactgtgcgaaaggttgttagtcttttgactactggggccagggaaccctggtcaccgtctcgagc

SEQ ID NO: 161 - DNA, 348 bp, Artificial Sequence
  Description of Artificial Sequence: Synthetic polynucleotide ABT1-49
gaggtgcagctgttggagtctgggggaggcttggtacagcctggggggtccctgcgtctctcctgtgcagcctccggattcacctttaatttgtatgcgatgaggtgggtccgccaggctccagggaagggtctagagtgggtctcagctatttcgccgatgggtaagggtacatattacgcagactccgtgaagggccggttcaccatctcccgcgacaattccaagaacacgctgtatctgcaaatgaacagcctgcgtgccgaggacaccgcggtatattactgtgcgaaagtggggtatatttttgactactggggccagggaaccctggtcaccgtctcgagc

SEQ ID NO: 162 - DNA, 348 bp, Artificial Sequence
  Description of Artificial Sequence: Synthetic polynucleotide ABT1-50
gaggtgcagctgttggagtctgggggaggcttggtacagcctggggggtccctgcgtctctcctgtgcagccaccggattcacctttagcagctatgccatgagctgggtccgccaggctccagggaagggtctagagtgggtctcatctatttcgtcgggtggtagtgctacagcgtacgcagactccgtgaagggccggttcaccatctcccgcgacaattccaagaacacgctgtatctgcaaatgaacagcctgcgtgccgaggacaccgcggtatattactgtgcgaaaaggtcttatctgtttgactactggggccagggaaccctggtcaccgtctcgagc

SEQ ID NO: 163 - DNA, 348 bp, Artificial Sequence
  Description of Artificial Sequence: Synthetic polynucleotide ABT1-51
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcagctattagtggtagtggtggtagcacatactacgcagactccgtgaagggccggttcaccatctcccgtgacaattccaagaacacgctgtatctgcaaatgaacagcctgcgtgccgaggacaccgcggtatattactgtgcgaaaagttatggtgcttttgactactggggccagggaaccctggtcaccgtctcgagc

SEQ ID NO: 164 - DNA, 348 bp, Artificial Sequence
  Description of Artificial Sequence: Synthetic polynucleotide ABT1-52
gaggtgcagctgttggagtctgggggaggcttggtacagcctggggggtccctgcgtctctcctgtgcagcctccggattcacctttaggagttatcggatgagttgggtccgccaggctccagggaagggtctagagtgggtctcaagtatttctgctatgggtcgtcgtacactttacgcagactccgtgaagggccggttcaccatctcccgcgacaattccaagaacacgctgtatctgcaaatgaacagcctgcgtgccgaggacaccgcggtatattactgtgcgaaagttggggcgcgttttgactactggggccagggaaccctggtcaccgtctcgagc

SEQ ID NO: 165 - DNA, 348 bp, Artificial Sequence
  Description of Artificial Sequence: Synthetic polynucleotide ABT1-75
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcaacgattactcctggtggttctgggacatactacgcagactccgtgaagggccggttcaccatctcccgcgacaattccaagaacacgctgtatctgcaaatgaacagcctgcgtgccgaggacaccgcggtatattactgtgcgaaaaggaagtttgcttttgactactggggtcagggaaccctggtcaccgtctcgagc

SEQ ID NO: 166 - DNA, 360 bp, Artificial Sequence
  Description of Artificial Sequence: Synthetic polynucleotide ABT1-76
gaggtgcagctgttggagtctgggggaggcttggtacagcctggggggtccctgcgtctctcctgtgcagcctccggattcacctttcctctttatgatatgtcgtgggtccgccaggctccagggaagggtctagagtgggtctcaaggattcgtgcgaatggtggtcggacatactacgcagactccgtgaagggccggttcaccatctcccgcgacaattccaagaacacgctgtatctgcaaatgaacagcctgcgtgccgaggacaccgcggtatattactgtgcgaaaacggcggcttgggttaagggtaattttgactactggggtcagggaaccctggtcaccgtctcgagc

SEQ ID NO: 167 - DNA, 360 bp, Artificial Sequence
  Description of Artificial Sequence: Synthetic polynucleotide ABT1-77
gaggtgcagctgttggagtctgggggaggcttggtacagcctggggggtccctgcgtctctcctgtgcagcctccggattcacctttgtgcgttattctatgctgtgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgcgaaaccttctaggatgagtcttaagaagtttgactactggggtcagggaaccctggtcaccgtctcgagc

SEQ ID NO: 168 - DNA, 360 bp, Artificial Sequence
  Description of Artificial Sequence: Synthetic polynucleotide ABT1-78
gaggtgcagctgttggagtctgggggaggcttggtacagcctggggggtccctgcgtctctcctgtgcagcctccggattcacctttgggcattatacgatgacttgggtccgccaggctccagggaagggtccagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaaagtattgagctgtcgggtggggcgtttgactactggggccagggaaccctggtcaccgtctcgagc

SEQ ID NO: 169 - DNA, 360 bp, Artificial Sequence
  Description of Artificial Sequence: Synthetic polynucleotide ABT1-79
gaggtgcagctgttggagtctgggggaggcttggtacagcctggggggtccctgcgtctctcctgtgcagcctccggattcacctttgaggattatcatatggcttgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaaaaggcttctggtcgtcgttcgatgtttgactactggggccagggaaccctggtcaccgtctcgagc

SEQ ID NO: 170 - DNA, 360 bp, Artificial Sequence
  Description of Artificial Sequence: Synthetic polynucleotide ABT1-81
gaggtgcagctgttggagtctgggggaggcttggtacagcctggggggtccctgcgtctctcctgtgcagcctccggattcacctttagcagctatgccatgagctgggtccgccaggctccagggaagggtctagagtgggtctcagctattagtggtagtggtggtagcacatactacgcagactccgtgaagggccggttcaccatctcccgcgacaattccaagaacacgctgtatctgcaaatgaacagcctgcgtgccgaggacaccgcggtatattactgtgcgaaagctcgggtggcgccggctgttctgtttgactaccggggccagggaaccctggtcaccgtctcgagc

SEQ ID NO: 171 - DNA, 348 bp, Artificial Sequence
  Description of Artificial Sequence: Synthetic polynucleotide ABT1-84
gaggtgcagctgtcggagtctgggggaggcttggtacagcctggggggtccctgcgtctctcctgtgcagcctccggattcacctttaatgattataggatggtgtgggcccgccaggctccagggaagggtctagagtgggtctcaactattagtaagtctggtcggactacatactacgcagactccgtgaagggccggttcaccatctcccgcgacaattccaagaacacgctgtatctgcaaatgaacagcctgcgtgccgaggataccgcggtatattactgtgcgaaatatacgattccgtttgactactggggtcagggaaccctggtcaccgtctcgagc

SEQ ID NO: 172 - DNA, 366 bp, Artificial Sequence
  Description of Artificial Sequence: Synthetic polynucleotide ABT1-85
gaggtgcagctgttggagtctgggggaggcttggtacagcctggggggtccctgcgtctctcctgtgcagcctccggactcacctttagtttgtatgggatggcgtgggcccgccaggctccagggaagggtctagagtgggtctcaagtatttcgtctagtggtagtagtacatactacgcagactccgtgaagggccggttcaccatctcccgcgacaattccaagaacacgctgtatctgcaaatgaacagcctgcgtgccgaggacaccgcggtatattactgtgcgaaacagcgttggtctcatggtagtgtgcttggttttgactactggggtcagggaaccctggtcaccgtctcgagc

SEQ ID NO: 173 - DNA, 366 bp, Artificial Sequence
  Description of Artificial Sequence: Synthetic polynucleotide ABT1-86
gaggtgcagctgttggagtctgggggaggcttggtacagcctggggggtccctgcgtctctcctgtgcagcctccggattcacctttgatcgttatattatggcttgggtccgccaggctccagggaagggtctggagtgggtctcatcgattactcctagtggtgctgctacatactacgcagactccgtgaagggccggttcaccatctcccgcgacaattccaagaacacgctgtatctgcaaatgaacagcctgcgtgccgaggacaccgcggtatattactgtgcggaagagcctgctgataggtatagtacgtggacttttgactactggggtcagggaaccctggtcaccgtctcgagc

SEQ ID NO: 174 - DNA, 372 bp, Artificial Sequence
  Description of Artificial Sequence: Synthetic polynucleotide ABT1-87
gaggtgcagctgttggagtctgggggaggcttggtacagcctggggggtccctgcgtctctcctgtgcagcctccggattcacctttggggcgtataatatgaattgggtccgccaggctccagggaagggtctagagtgggtctcaactatttctgcttcgggtcgttatacatactacgcagactccgtgaagggccggttcaccatcttccgcgacaattccaagaacacgctgtatctgcaaatgaacagcctgcgtgccgaggacaccgcggtatattactgtgcggaagggtttatttctgtggatgagtatgtgccgtatcattttgactactggggtcagggaaccctggtcaccgtctcgagc

SEQ ID NO: 175 - DNA, 366 bp, Artificial Sequence
  Description of Artificial Sequence: Synthetic polynucleotide ABT1-88
gaggtgcagctgttggagtctgggggaggcttggtacagcctggggggtccctgcgtctctcctgtgcagcctccggattcacctttaggttgtataagatgtcttgggtccgccaggctccagggaagggtctagagtgggtctcaagtattagttctaatggtgaggggacatactacgcagactccgtgaagggccggttcaccatctcccgcgacaattccaagaacacgctgtatctgcaaatgaacagcctgcgtgccgaggacaccgcggtatattactgtgcgaaaactttgtatctgtgggggtcgaggcaggcttttgactactggggtcagggaaccctggtcaccgtctcgagc

SEQ ID NO: 176 - DNA, 372 bp, Artificial Sequence
  Description of Artificial Sequence: Synthetic polynucleotide ABT1-89
gaggtgcagctgttggagtctgggggaggcttggtacagcctggggggtccctgcgtctctcctgtgcagcctccggattcacctttcggttgtatgggatgaattgggtccgccaggctccagggaagggtctagagtgggtctcagctatttcttcggatggtcagaggacatactacgcagactccgtgaagggccggttcaccatctcccgcgacaattccaagaacacgctgtatctgcaaatgaacagcctgcgtgccgaggacaccgcggtatattactgtgcgaaagggtggttgaggggtcataatcttatgcggacggagtttgactactggggtcagggaaccctggtcaccgtctcgagc

SEQ ID NO: 177 - DNA, 369 bp, Artificial Sequence
  Description of Artificial Sequence: Synthetic polynucleotide ABT1-90
gaggtgcagctgttggagtctgggggaggcttggtacagcctggggggtccctgcgtctctcctgtgcagcctccggattcacctttcatgattattggatgacgtgggtccgccaggctccagggaagggtctggagtgggtctcatctatttctgctttgggtggtgctacatactacgcagactccgtgaagggccggttcaccatctcccgcgacaattccaagaacacgctgtatctgcaaatgaacagcctgcgtgccgaggacaccgcggtatattactgtgcgaaagggcttcttcgggagccgcagtggcggcagggttttgactactggggtcagggaaccctggtcaccgtctcgagc

SEQ ID NO: 178 - DNA, 351 bp, Artificial Sequence
  Description of Artificial Sequence: Synthetic polynucleotide ABT1-91
gaggtgcagctgttggagtctgggggaggcttggtacagcctggggggtccctgcgtctctcctgtgcagcctccggattcacctttacggattatactatgatgtgggtccgccaggctccagggaagggtctagagtgggtctcaagtattgagcggsatggtcggcggacatactacgcagactccgtgaagggccggttcaccatctcccgcgacaattccaagaacacgctgtatctgcaaatgaacagcctgcgtgccgaggataccgcggtatattactgtgcgaaagggcaggcgaagttttttgactactggggtcagggaaccctggtcaccgtctcgagc

SEQ ID NO: 179 - DNA, 360 bp, Artificial Sequence
  Description of Artificial Sequence: Synthetic polynucleotide ABT1-92
gaggtgcagctgttggagtctgggggaggcttggtacagcctggggggtccctgcgtctctcctgtgcagcctccggattcaccttttctacgtatactatgacttgggtccgccaggctccagggaagggtctagagtgggtctcaactatttttcctgggggttcgacgacatactacgcagactccgtgaagggccggttcaccatctcccgcgacaattccaagaacacgctgtatctgcaaatgaacagcctgcgtgccgaggacaccgcggtatattactgtgcgaaatatgttgattttgtgaagttgtcttttgactactggggtcagagaaccctggtcaccgtctcgagc

SEQ ID NO: 180 - DNA, 372 bp, Artificial Sequence
  Description of Artificial Sequence: Synthetic polynucleotide ABT1-93
gaggtgcagctgttggagtctgggggaggcttggtacagcctggggggtccctgcgtctctcctgtgcagcctccggattcacctttaatgagtataatatggtgtgggtccgccaggctccagggaagggtctagagtgggtctcaagtatttctgggggtggtgggtttacatactacgcagactccgtgaagggccggttcaccatctcccgcgacaattccaagaacacgctgtatctgcaaatgaacagcctgcgtgccgaggataccgcggtatattactgtgcgaaacctctgagggggtttgtgtgttcgcagcattgttcttttgactactggggtcagggaaccctggtcaccgtctcgagc

SEQ ID NO: 181 - DNA, 348 bp, Artificial Sequence
  Description of Artificial Sequence: Synthetic polynucleotide ABT1-94
gaggtgcagctgttggagtctgggggaggcttggtacagcctggggggtccctgcgtctctcctgtgcagcctccggattcacctttcatgtgtatgatatggggtgggtccgccaggctccagggaagggtctagagtgggtctcatttattgatcggatgggtcgtcgtacatactacgcagactccgtgaagggccggttcaccatctcccgcgacaattccaagaacacgctgtatctgcaaatgaacagcctgcgtgccgaggataccgcggtatattactgtgcgaaacctgggtatccgtttgactactggggtcagggaaccctggtcaccgtctcgagc

SEQ ID NO: 182 - DNA, 360 bp, Artificial Sequence
  Description of Artificial Sequence: Synthetic polynucleotide ABT1-96
gaggtgcagctgttggagtctgggggaggcttggtacagcctggggggtccctgcgtctctcctgtgcagcctccggattcacctttaatcagtataatatgttttgggtccgccaggctccagggaagggtctagagtgggtctcagttattagtggttcgggtcggtttacatactacgcagactccgtgaagggccggttcaccatctcccgcgacaattccaagaacacgctgtatctgcaaatgaacagcctgcgtgccgaggataccgcggtatattactgtgcgaaagggtggtggaggcgtgatcctccttttgactactggggtcagggaaccctggtcaccgtctcgagc

SEQ ID NO: 183 - DNA, 360 bp, Artificial Sequence
  Description of Artificial Sequence: Synthetic polynucleotide ABT1-97
gaggtgcagctgttggagtctgggggaggcttggtacagcctggggggtccctgcgtctctcctgtgcagcctccggattcaccttttgggagtatgatatgtattgggtccgccaggctccagggaagggtctagagtgggtctcacggatttctggttcgggtcgttatacatactacgcagactccgtgaagggccggttcaccatctcccgcgacaattccaagaacacgctgtatctgcaaatgaacagcctgcgtgccgaggacaccgcggtatattactgtgcgaaaaggtcgcttactcgtccgagtcagtttgactactggggtcagggaaccctggtcaccgtctcgagc

SEQ ID NO: 184 - DNA, 348 bp, Artificial Sequence
  Description of Artificial Sequence: Synthetic polynucleotide ABT1-98
gaggtgcagctgttggagtctgggggaggcttggtacagcctggggggtccctgcgtctctcctgtgcagcctccggattcacctttgatggttatattatgtcgtgggtccgccaggctccagggaagggtctagagtgggtctcaactattagtccgttgggttctgttacatactacgcagactccgtgaagggccggttcaccatctcccgcgacaattccaagaacacgctgtatctgcaaatgaacagcctgcgtgccgaggacaccgcggtatattactgtgcgaaaaaggggccgtggtttgactactggggtcagggaaccctggtcaccgtctcgagc

SEQ ID NO: 185 - DNA, 366 bp, Artificial Sequence
  Description of Artificial Sequence: Synthetic polynucleotide ABT1-99
gaggtgcagctgttggagtctgggggaggcttggtacagcctggggggtccctgcgtctctcctgtgcagcctccggattcacctttggtaagtattctatgacgtgggtccgccaggctccagggaagggtctagagtgggtctcagttattgatccgtggggtcattatacatactacgcagactccgtgaagggccggttcaccatctcccgcgacaattccaagaacacgctgtatctgcaaatgaacagcctgcgtgccgaggacaccgcggtatattactgtgcgaaatcggttgatgctacgctgttgcgtaggtattttgactactggggtcagggaaccctggtcaccgtctcgagc

SEQ ID NO: 186 - DNA, 348 bp, Artificial Sequence
  Description of Artificial Sequence: Synthetic polynucleotide ABT1-101
gaggtgcagctgttggagtctgggggaggcttggtacagcctggggggtccctgcgtctctcctgtgcagcctccggattcaccttttcgaagtattggatgagttgggtccgccaggctccagggaagggtctggagtgggtctcatctatttctcctgatggtaagactacatactacgcagactccgtgaagggccggttcaccatctcccgcgacaattccaagaacacgctgtatctgcaaatgaacagcctgcgtgccgaggacaccgcggtatattactgtgcgaaaggtgcgtttgcgtttgactactggggtcagggaaccctggtcaccgtctcgagc

SEQ ID NO: 187 - DNA, 347 bp, Artificial Sequence
  Description of Artificial Sequence: Synthetic polynucleotide ABT1-102
gaggtgcagctgttggagtctgggggaggcttggtacagcctggggggtccctgcgtctctcctgtgcagcctccggattcacctttcggaattatgcgatgtcttgggtccgccaggctccagggaagggtctagagtgggtctcaacgattactccgctgggttctagtacatactatgcagactccgtgaagggccggttcaccatctcccgcgacaattccaagaacacgctgtatctgcaaatgaacagcctgcgtgccgaggacaccgcggtatattactgtgcgaaaagggcgtgggcttttgactactggggtcagggaacctggtcaccgtctcgagc

SEQ ID NO: 188 - DNA, 348 bp, Artificial Sequence
  Description of Artificial Sequence: Synthetic polynucleotide ABT1-103
gaggtgcagctgttggagtctgggggaggcttggtacggcctggggggtccctgcgtctctcctgtgcagcctccggattcacctttgagcggtattggatgacttgggtccgccaggctccagggaagggtctagagtgggtctcatatatttcgagtagtggtacggctacatactacgcagactccgtgaagggccggttcaccatctcccgcgacaattccaagaacacgctgtatctgcaaatgaacagcctgcgtgccgaggacaccgcggtatattactgtgcgaaaggggctccgaattttgactactggggtcagggaaccctggtcaccgtctcgagc

SEQ ID NO: 189 - DNA, 348 bp, Artificial Sequence
  Description of Artificial Sequence: Synthetic polynucleotide ABT1-104
gaggtgcagctgttggagtctgggggaggcttggtacagcctggggggtccctgcgtctctcctgtgcagcctccggattcacctttaagtcttatcctatgcgttgggtccgccaggctccagggaagggtctagagtgggtctcaacgattagtcctttgggttctacgacatactacgcagactccgtgaagggccggttcaccatctcccgcgacaattccaagaacacgctgtatctgcaaatgaacagcctgcgtgccgaggacaccgcggtatattactgtgcgaaagcttcttattcttttgactactggggtcagggaaccctggtcaccgtctcgagc

SEQ ID NO: 190 - DNA, 348 bp, Artificial Sequence
  Description of Artificial Sequence: Synthetic polynucleotide ABT1-105
gaggtgcagctgttggagtctgggggaggcttggtacagcctggggggtccctgcgtctctcctgtgcagcctctggattcaccttttcgcagtatcgtatgttttgggcccgccaggctccagggaagggtctagagtgggtctcaactattagtacttcgggtaataagacatactacgcagactccgtgaagggccggttcaccatctcccgcgacaattccaagaacacgctgtatctgcaaatgaacagcctgcgtgccgaggacaccgcggtatattactgtgcgaaagtttctaagccgtttgactactggggtcagggaaccctggtcaccgtctcgagc

SEQ ID NO: 191 - DNA, 348 bp, Artificial Sequence
  Description of Artificial Sequence: Synthetic polynucleotide ABT1-106
gaggtgcagctgttggagtctgggggaggcttggtacagcctggggggtccctgcgtctctcctgtgcagcctccggattcacctttgagaattatactatgaagtgggtccgccaggctccagggaagggtctagagtgggtctcatctatttcgcctgttggttcggttacatactacgcagactccgtgaagggccggttcaccatctcccgcgacaattccaagaacacgctgtatctgcaaatgaacagcctgcgtgccgaggataccgcggtatattactgtgcgaaaccgtcgcctttttttgactactggggtcagggaaccctggtcaccgtctcgagc

SEQ ID NO: 192 - DNA, 366 bp, Artificial Sequence
  Description of Artificial Sequence: Synthetic polynucleotide ABT1-109
gaggtgcagctgttggagtctgggggaggcttggtacagcctggggggtccctgcgtctctcctgtgcagcctccggattcacctttgctgggtataatatgatgtgggtccgccaggctccagggaagggtctagagtgggtctcaactattgcgtatgatggttatcgtacatactacgcagactccgtgaagggccggttcaccatctcccgcgacaattccaagaacacgctgtatctgcaaatgaacagcctgcgtgccgaggacaccgcggtatattactgtgcgaaaaatatgcagattactaggccgcgtccgacgtttgactactggggtcagggaaccctggtcaccgtctcgagc

SEQ ID NO: 193 - DNA, 366 bp, Artificial Sequence
  Description of Artificial Sequence: Synthetic polynucleotide ABT1-110
gaggtgcagctgttggagtctgggggaggcttggtacagcctggggggtccctgcgtctctcctgtgcagcctccggattcacctttagtcggtataatatgatgtgggtccgccaggctccagggaagggtctagagtgggtctcaactatttcgtatgatggttttcgtacatactacgcagactccgtgaagggccggttcaccatctcccgcgacaattccaagaacacgctgtatctgcaaatgaacagcctgcgtgccgaggacaccgcggtatattactgtgcgaaaaatcattctactcagggtaaggcgaatgtgtctgactactggggtcagggaaccctggtcaccgtctcgagc

SEQ ID NO: 194 - DNA, 366 bp, Artificial Sequence
  Description of Artificial Sequence: Synthetic polynucleotide ABT1-111
gaggtgcagctgttggagtctgggggaggcttggtacagcctggggggtccctgcgtctctcctgtgcagcctccggattcaccttttctaattatggtatgcagtgggtccgccaggctccagggaagggtctagagtgggtctcatatattagtggttctggtttgcttacatactacgcagactccgtgaagggccggttcaccatctcccgcgacaattccaagaacacgctgtatctgcaaatgaacagcctgcgtgccgaggataccgcggtatattactgtgcgaaatctgatgtgggtttgcggctgcctgcttcttttgactactggggtcagggaaccctggtcaccgtctcgagc

SEQ ID NO: 195 - DNA, 369 bp, Artificial Sequence
  Description of Artificial Sequence: Synthetic polynucleotide ABT1-113
gaggtgcagctgttggagtctgggggaggcttggtacagcctggggggtccctgcgtctctcctgtgcagcctccggattcacctttcagaattatgatatgacgtgggtccgccaggctccagggaagggtctagagtgggtctcaacgatttctagtggtggttcgttgacatactacgcagactccgtgaagggccggttcaccatctcccgcgacaattccaagaacacgctgtatctgcaaatgaacagcctgcgtgccgaggacaccgcggtatattactgtgcgaaacttagttatcgttggtcgtatacgttttcggattttgactactggggtcagggaaccctggtcaccgtctcgagc

SEQ ID NO: 196 - DNA, 297 bp, Artificial Sequence
  Description of Artificial Sequence: Synthetic polynucleotide ABT1-117
gaggtgcagctgttggagtccgggggaggcttggtacagcctggggggtccctgcgtctctcctgtgcagcctccggattcacctttgcggggtatgatatgctgtgggtccgccaggctccagggaagggtctagagtgggtctcaatgattctggggactggtagtggtacatactacgcagactccgtgaagggccggttcaccatctcccgcgacaattccaagaacacgctgtatctgcaaatgaacagcctgcgtgccgaggacaccgcggtatattactgtgcgaaacgg

SEQ ID NO: 197 - DNA, 366 bp, Artificial Sequence
  Description of Artificial Sequence: Synthetic polynucleotide ABT1-118
gaggtgcagctgttggagtctgggggaggcttggtacagcctggggggtccctgcgtctctcctgtgcagcctccggattcacctttggggcgtatactatgtattgggtccgccaggctccagggaagggtctagagtgggtctcacatatttcgccggtgggttctgatacatactacgcagactccgtgaagggccggttcaccatctcccgcgacaattccaagaacacgctgtatctgcaaatgaacagcctgcgtgccgaggacaccgcggtatattactgtgcgaaatttgtttttttggcggggcgtttgcctacttttgactactggggtcagggaaccctggtcaccgtctcgagc

SEQ ID NO: 198 - DNA, 348 bp, Artificial Sequence
  Description of Artificial Sequence: Synthetic polynucleotide ABT1-137
gaggtgcagctgttggagtctgggggaggcttggtacagcctggggggtccctgcgtctctcctgtgcagcctccggattcacctttgagaggtattggatggcttgggtccgccaggctccagggaagggtctagagtgggtctcaaatattaatcttactggtagtgcgacatactacgcagactccgtgaagggccggttcaccatctcccgcgacaattccaagaacacgctgtatctgcaaatgaacagcctgcgtgccgaggataccgcggtatattactgtgcgaaaggggcttttcagtttgactactggggtcagggaaccctggtcaccgtctcgagc

SEQ ID NO: 199 - DNA, 360 bp, Artificial Sequence
  Description of Artificial Sequence: Synthetic polynucleotide ABT1-139
gaggtgcagctgttggagtctgggggaggcttggtacagcctggggggtccctgcgtctctcctgtgcagcctccggatttaccttttctgattatacgatgatttgggtccgccaggctccagggaagggtctggagtgggtctcatctatttcggctcgtggttggggtacatactacgcagactccgtgaagggccggttcaccatctcccgcgacaattccaagaacacgctgtatctgcaaatgaacagcctgcgtgccgaggacaccgcggtatattactgtgcgaaaggtagtcctcagcttgttctgccttttgactactggggtcagggaaccctggtcaccgtctcgagc

SEQ ID NO: 200 - DNA, 363 bp, Artificial Sequence
  Description of Artificial Sequence: Synthetic polynucleotide ABT1-140
gaggtgcagctgttggagtctgggggaggcttggtacagcctggggggtccctgcgtctctcctgtgcagcctccggattcacctttgaggattatgagatggattgggtccgccaggctccagggaagggtctagagtgggtctcaactatttctcctcatggtctgcttacatactacgcagactccgtgaagggccggttcaccatctcccgcgacaattccaagaacacgctgtatctgcaaatgaacagcctgcgtgccgaggacaccgcggtatattactgtgcgaaacgtttgtggcctcagaggaagtggacttttgactactggggtcagggaaccctggtcaccgtctcgagc

SEQ ID NO: 201 - DNA, 360 bp, Artificial Sequence
  Description of Artificial Sequence: Synthetic polynucleotide ABT1-147
gaggtgcagctgttggagtctgggggaggcttggtacagcctggggggtccctgcgtctctcctgtgcagcctccggattcaccttttctacttataatatgatgtgggtccgccaggctccagggaagggtctagagtgggtctcaagtattacgcatgagggtacgatgacatactacgcagactccgtgaagggccggttcaccatctcccgcgacaattccaagaacacgctgtatctgcaaatgaacagcctgcgtgccgaggacaccgcggtatattactgtgcgaaaaatggtcgtattagtcagaatcggtttgactactggggtcagggaaccctggtcaccgtctcgagc

SEQ ID NO: 202 - DNA, 324 bp, Artificial Sequence
  Description of Artificial Sequence: Synthetic polynucleotide ABT1 VK dAbs:ABT1-3
gacatccagatgacccagtctccatcctccctgtctgcatctgtaggagaccgtgtcaccatcacttgccgggcaagtcagagcatttggacggagttaaagtggtaccagcagaaaccagggaaagcccctaagctcctgatctatggtgcatccctgttgcaaagtggggtcccatcacgtttcagtggcagtggatctgggacagatttcactctcaccatcagcagtctgcaacctgaagattttgctacgtactactgtcaacagtttgcgtattttccttttacgttcggccaagggaccaaggtggaaatcaaacgg

SEQ ID NO: 203 - DNA, 324 bp, Artificial Sequence
  Description of Artificial Sequence: Synthetic polynucleotide ABT1-9
gacatccagatgacccagtctccatcctccctgtctgcatctgtaggagaccgtgtcaccatcacttgccgggcaagtcagagcattggttcgtcgttactttggtaccagcagaaaccagggaaagcccctaagctcctgatctatttggcatcccgtttgcaaagtggggtcccatcacgtttcagtggcagtggatctgggacagacttcactctcaccatcagcagtctgcaacctgaagattttgctacgtactactgtcaacagtttcggtctacgcctaatacgttcggccaagggaccaaggtggaaatcaaacgg

SEQ ID NO: 204 - DNA, 324 bp, Artificial Sequence
  Description of Artificial Sequence: Synthetic polynucleotide ABT1-9-500
gatattcagatgacccagagcccgagcagcctgagcgcgagcgtgggcgatcgtgtgaccattacctgccgtgcgagccatcgtattcaggtgagcctgaactggtatcagcgtaaaccgggcaaagcgccgaaactgctggtgtatctggcgagccgtctgcagagcggcgtgccgagccgttttagcggcagcggcagcggcagcgattttaccctgaccattagcagcctgcagccgggcgattttgcgacctattattgccagcagtttcgtagcaccccgaacacctttggccagggcaccaaagtggaaattcgtcgt

SEQ ID NO: 205 - DNA, 324 bp, Artificial Sequence
  Description of Artificial Sequence: Synthetic polynucleotide ABT1-10
gacatccagatgacccagtctccatcctccctgtctgcatctgtaggagaccgtgtcaccatcacttgccgggcaagtcagagcattgtgccgaatttaaggtggtaccagcagaaaccagggaaagcccctaagctcctgatctatggtgcatccacgttgcaaagtggggtcccatcacgtttcagtggcagtggatctgggacagatttcactctcaccatcagcagtctgcaacctgaagattttgctacgtactactgtcaacagggttatgtttatcctgggacgttcggccaagggaccaaggtggaaatcaaacgg

SEQ ID NO: 206 - DNA, 324 bp, Artificial Sequence
  Description of Artificial Sequence: Synthetic polynucleotide ABT1-11
gacatccagatgacccagtctccatcctccctgtctgcatctgtaggagaccgtgtcaccatcacttgccgggcaagtcagagcattccgtataatttacgttggtaccagcagaaaccagggaaagcccctaagctcctgatctatagtgcatcccggttgcaaagtggggtcccatcacgtttcagtggcagtggatctgggacagatttcactctcaccatcagcagtctgcaacctgaagattttgctacgtactactgtcaacaggggtatagttggcctatgacgttcggccaagggaccaaggtggaaatcaaacgg

SEQ ID NO: 207 - DNA, 324 bp, Artificial Sequence; identical to SEQ ID NO: 202
  Description of Artificial Sequence: Synthetic polynucleotide ABT1-12

SEQ ID NO: 208 - DNA, 324 bp, Artificial Sequence
  Description of Artificial Sequence: Synthetic polynucleotide ABT1-13
gacatccagatgacccagtctccatcctccctgtctgcatctgtaggagaccgtgtcaccatcacttgccgggcaagtcagagcattcgtacttttttaaattggtaccagcagaaaccagggaaagcccctaagctcctgatctattgggcatcccctttgcaaagtggggtcccatcacgtttcagtggcagtggatctgggacagatttcactctcaccatcagcagtctgcaacctgaagattttgctacgtactactgtcaacagactagtcgggctccttatacgttcggccaagggaccaaggtggaaatcaaacgg

SEQ ID NO: 209 - DNA, 324 bp, Artificial Sequence; identical to SEQ ID NO: 202
  Description of Artificial Sequence: Synthetic polynucleotide ABT1-14

SEQ ID NO: 210 - DNA, 324 bp, Artificial Sequence
  Description of Artificial Sequence: Synthetic polynucleotide ABT1-18
gacatccagatgacccagtctccatcctccctgtctgcatctgtaggagaccgtgtcaccatcacttgccgggcaagtcagagcattcagcgttggttagcttggtaccagcagaaaccagggaaagcccctaagctcctgatctattttgcatcccagttgcaaagtggggtcccatcacgtttcagtggcagtggatctgggacagatttcactctcaccatcagcagtctgcaacctgaagattttgctacgtactactgtcaacagttgctgaggttgcctaagacgttcggccaagggaccaaggtggaaatcaaacgg

SEQ ID NO: 211 - DNA, 324 bp, Artificial Sequence
  Description of Artificial Sequence: Synthetic polynucleotide ABT1-24
gacatccagatgacccagtctccatcctccctgtctgcatctgtaggagaccgtgtcaccatcacttgccgggcaagtcagagcattagggctaagttacgttggtaccagcagaaaccagggaaagcccctaagctcctgatctatagggcatcccagttgcaaagtggggtcccatcacgtttcagtggcagtggatctgggacagatttcactctcaccatcagcagtctgcaacctgaagattttgctacgtactactgtcaacagagggctcggcatcctcatacgttcggccaagggaccaaggtggaaatcaaacgg

SEQ ID NO: 212 - DNA, 324 bp, Artificial Sequence
  Description of Artificial Sequence: Synthetic polynucleotide ABT1-25
gacatccagatgacccagtctccatcctccctgtctgcatctgtaggagaccgtgccaccatcacttgccgggcaagtcagagcattagggctaagttacgttggtaccagcagaaaccagggaaagcccctaagctcctgatctatagggcatcccagttgcaaagtggggtcccatcacgtttcagtggcagtggatctgggacagatttcactctcaccatcagcagtctgcaacctgaagattttgctacgtactactgtcaacagagggctcggcatcctcatacgttcggccaagggaccaaggtggaaatcaaacgg

SEQ ID NO: 213 - DNA, 324 bp, Artificial Sequence
  Description of Artificial Sequence: Synthetic polynucleotide ABT1-26
gacatccagatgacccagtctccatcctccctgtctgcatccgtaggagaccgtgtcaccatcacttgccgggcaagtcagagcattggtaatgttttacggtggtaccagcagaaaccagggaaagcccctaagctcctgatctatcgtgcagccatgttgcaaagtggggtcccatcacgtttcagtggcagtggatctgggacagatttcactctcaccatcagcagtctgcaacctgaagattttgctacgtactactgtcaacagaggcggacttatccttggacgttcggccaagggaccaaggtggaaatcaaacgg

SEQ ID NO: 214 - DNA, 324 bp, Artificial Sequence
  Description of Artificial Sequence: Synthetic polynucleotide ABT1-27
gacatccagatgacccagtctccatcctccctgtctgcatctgtaggagaccgtgtcaccatcacttgccgggcaagtcagagcattaagcagaagttaaagtggtaccagcagaaaccagggaaagcccctaagctcctgatctattgggcatcccatttgcaaagtggggtcccatcacgtttcagtggcagtggatctgggacagatttcactctcaccatcagcagtctgcaacctgaagattttgctacgtactactgtcaacagcggcatctgaagccttatacgttcggccaagggaccaaggtggaaatcaaacgg

SEQ ID NO: 215 - DNA, 324 bp, Artificial Sequence
  Description of Artificial Sequence: Synthetic polynucleotide ABT1-28
gacatccagatgacccagtctccatcctccctgtctgcatctgtaggagaccgtgtcaccatcacttgccgggcaagtcagagcattaagaatcggttacgttggtaccagcagaaaccagggaaagcccctaagctcctgatctatcgtgcatccaagttgcaaagtggggtcccatcacgtttcagtggcagtggatctgggacagatttcactctcaccatcagcagtctgcaacctgaagattttgctacgtactactgtcaacagcggtatcatattcctaggacgttcggccaagggaccaaggtggaaatcaaacgg

SEQ ID NO: 216 - DNA, 324 bp, Artificial Sequence
  Description of Artificial Sequence: Synthetic polynucleotide ABT1-29
gacatccagatgacccagtctccatcctccctgtctgcatctgtaggagaccgtgtcaccatcacttgccgggcaagtcagagcattcgttctcgtttatcgtggtaccagcagaaaccagggaaagcccctaagctcctgatctatagggcatcccagttgcaaagtggggtcccatcacgtttcagtggcagtggatctgggacagatttcactctcaccatcagcagtctgcaacctgaagattttgctacgtactactgtcaacagcgttttatttggcctaggacgttcggccaagggaccaaggtggaaatcaaacgg

SEQ ID NO: 217 - DNA, 324 bp, Artificial Sequence
  Description of Artificial Sequence: Synthetic polynucleotide ABT1-30
gacatccagatgacccagtctccatcctccctgtctgcatctgtaggagaccgtgtcaccatcacttgccgggcaagtcagagcattaataggggtttaaggtggtaccagcagaaaccagggaaagcccctaagctcctgatctatcgtgcatccgttttgcaaagtggggtcccatcacgtttcagtggcagtggatctgggacagatttcactctcaccatcagcagtctgcaacctgaagattttgctacgtactactgtcaacaggtgagtcgtcgtcctcggacgttcggccaagggaccaaggtggaaatcaaacgg

SEQ ID NO: 218 - DNA, 324 bp, Artificial Sequence
  Description of Artificial Sequence: Synthetic polynucleotide ABT1-53
gacatccagatgacccagtctccatccaccctgtctgcatctgtaggagaccgtgtcaccatcacttgccgggcaagtcagagcattagggctaagttacgttggtaccagcagaaaccagggaaggcccctaagctcctgatctataaggcatcccggttgcaaagtggggtcccatcacgtttcagtggcagtggatctgggacagatttcactctcaccatcagcagtctgcaacctgaagattttgctacgtactactgtcaacagcgtgggcttcttccttttacgttcggccaagggaccaaggtagaaatcaaacgg

SEQ ID NO: 219 - DNA, 324 bp, Artificial Sequence
  Description of Artificial Sequence: Synthetic polynucleotide ABT1-54
gacatccagatgacccagtctccatcctccctgtctgcatctgtaggagaccgtgtcaccatcacttgccgggcaagtcagagcattggtaggaagttacggtggtaccagcagaaaccagggaaagcccctaagctcctgatctatcatgcatccattttgcaaagtggggtcccatcacgtttcagtggcagtggatctgggacagatttcactctcaccatcagcagtctgcaacctgaagattttgctacgtactactgtcaacagagggttcgtatgccttttacgttcggccaagggaccaaggtggaaatcaaacgg

SEQ ID NO: 220 - DNA, 324 bp, Artificial Sequence
  Description of Artificial Sequence: Synthetic polynucleotide ABT1-56
gacatccagatgacccagtctccatcctccctgtctgcatctgtaggagaccgtgtcaccatcacttgccgggcaagtcagagcattaagactcgtttacagtggtaccagcagaaaccagggaaagcccctaagctcctgatctatcatgcatccgtgttgcaaagtggggtcccatcacgtttcagtggcagtggatctgggacagatttcactctcaccatcagcagtctacaacctgaagattttgctacgtactactgtcaacagcggaagatgcgtcctcatacgttcggccaagggaccaaggtggaaatcaaacgg

SEQ ID NO: 221 - DNA, 324 bp, Artificial Sequence
  Description of Artificial Sequence: Synthetic polynucleotide ABT1-57
gacatccagatgacccagtctccatcctccctgtctgcatctgtaggagaccgtgtcaccatcacttgccgggcaagtcagagcattaagcgtgagttagcgtggtaccagcagaaaccagggaaagcccctaagctcctgatctataaggcatcccggttgcaaagtggggtcccatcacgtttcagtggcagtggatctgggacagatttcactctcaccatcagcagtctgcaacctgaagattttgctacgtactactgtcaacagaggaagtcgcatcctcggacgttcggccaagggaccaaggtggaaatcaaacgg

SEQ ID NO: 222 - DNA, 324 bp, Artificial Sequence
  Description of Artificial Sequence: Synthetic polynucleotide ABT1-59
gacatccagatgacccagtctccatcctccctgtctgcatctgtaggagaccgtgtcaccatcacttgccgggcaagtcagagcattgggcggcgtttagcttggtaccagcagaaaccagggaaagcccctaagctcctgatctattgggcatccaagttgcaaagtggggtcccatcacgtttcagtggcagtggatctgggacagatttcactctcaccatcagcagtctgcaacctgaagattttgctacgtactactgtcaacaggggaatgtgtggccttatacgttcggccaagggaccaaggtggaaatcaaacgg

SEQ ID NO: 223 - DNA, 324 bp, Artificial Sequence
  Description of Artificial Sequence: Synthetic polynucleotide ABT1-60
gacatccagatgacccagtctccatcctccctgtctgcatctgtaggagaccgtgtcaccatcacttgccgggcaagtcagagcattggtcgtcgtttaaagtggtaccagcagaaaccagggaaagcccctaagctcctgatctataaggcatccaggttgcaaagtggggtcccatcacgtttcagtggcagtggatctgggacagatttcactctcaccatcagcagtctgcaacctgaagattttgctacgtactactgtcaacagaatagtcatcatccttatacgttcggccaagggaccaaggtggaaatcaaacgg

SEQ ID NO: 224 - DNA, 324 bp, Artificial Sequence
  Description of Artificial Sequence: Synthetic polynucleotide ABT1-61
gacatccagatgacccagtctccatcctccctgtctgcatctgtaggagaccgtgtcaccatcacttgccgggcaagtcagagcattgggcatcgtttaaggtggtaccagcagaaaccagggaaagcccctaagctcctgatctataaggcatccctgttgcaaagtggggtcccatcacgtttcagtggcagtggatctgggacagatttcactctcaccatcagcagtctgcaacctgaagattttgctacgtactactgtcaacaggtgcgtgcgtatcctcgtacgttcggccaagggaccaaggtggaaatcaaacgg

SEQ ID NO: 225 - DNA, 324 bp, Artificial Sequence
  Description of Artificial Sequence: Synthetic polynucleotide ABT1-62
gacatccagatgacccagtctccatcccccctgtctgcatctgtaggagaccgtgtcaccatcacttgccgggcaagtcagagcattccgttttatttagggtggtaccagcagaaaccagggaaagcccctaagctcctgatctatagggcatccatgttgcaaagtggggtcccatcacgtttcagtggcagtggatctgggacagatttcactctcaccatcagcagtctgcaacctgaagattttgctacgtactactgtcaacagattcttcaggctcctccgacgttcggccaagggaccaaggtggaaatcaaacgg

SEQ ID NO: 226 - DNA, 324 bp, Artificial Sequence
  Description of Artificial Sequence: Synthetic polynucleotide ABT1-63
gacatccagatgacccagtctccatcctccctgtctgcatctgtaggagaccgtgtcaccatcacttgccgggcaagtcagagcattggtgcgtttttaggttggtaccagcagaaaccagggaaagcccctaagctcctgatctatcgggcatcccctttgcaaagtggggtcccatcacgtttcagtggcggtggatctgggacagatttcactctcaccatcagcagtctgcaacctgaagattttgctacgtactactgtcaacagcagcgtgtggttcctgggacgttcggccaagggaccaaggtggaaatcaaacgg

SEQ ID NO: 227 - DNA, 324 bp, Artificial Sequence
  Description of Artificial Sequence: Synthetic polynucleotide ABT1-64
gacatccagatgacccagtctccatcctccctgtctgcatctgtaggagaccgtgtcaccatcacttgccgggcaagtcagagcatttcgaaggtgttaggttggtaccagcagaaaccagggaaagcccctaagctcctgatctataaggcatccattttgcaaagtggggtcccatcacgtctcagtggcagtggatctgggacagatttcactctcaccatcagcagtctgcaacctgaagattttgctacgtactactgtcaacaggcgcttgattttccttatacgttcggccaagggaccaaggtggaaatcaaacgg

SEQ ID NO: 228 - DNA, 324 bp, Artificial Sequence
  Description of Artificial Sequence: Synthetic polynucleotide ABT1-65
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatctatgctgcatccagtttgcaaagtggggtcccatcacgtttcagtggcagtggatctgggacagatttcactctcaccatcagcagtctgcaacctgaagattttgctacgtactactgtcaacaggattatgattttcctattacgttcggccaagggaccaaggtggaaatcaaacgg

SEQ ID NO: 229 - DNA, 324 bp, Artificial Sequence
  Description of Artificial Sequence: Synthetic polynucleotide ABT1-66
gacatccagatgacccagtctccatcctccctgtctgcatctgtaggagaccgtgtcaccatcacttgccgggcaagtcagagcattatgcggaagttaaggtggtaccagcagaaaccagggaaagcccctaagctcctgatctataaggcatccaagttgcaaagtggggtcccatcacgtttcagtggcagtggatctgggacagatttcactctcaccatcagcagtctgcaacctgaagattttgctacgtactactgtcaacagagtcatcggaggccttatacgttcggccaagggaccaaggtggaaatcaaacgg

SEQ ID NO: 230 - DNA, 324 bp, Artificial Sequence
  Description of Artificial Sequence: Synthetic polynucleotide ABT1-67
gacatccagatgacccagtctccatcctccctgtctgcatctgtaggagaccgtgtcaccatcacttgccgggcaagtcagagcattcatcgttctttacgttggtaccagcagaaaccagggaaagcccctaagctcctgatctatcatgcatcccatttgcaaagtggggtcccatcacgtttcagtggcagtggatctgggacagatttcactctcaccatcagcagtctgcaacctgaagattttgctacgtactactgtcaacagtataagcggcgtccttctacgttcggccaagggaccaaggtggaaatcaaacgg

SEQ ID NO: 231 - DNA, 324 bp, Artificial Sequence
  Description of Artificial Sequence: Synthetic polynucleotide ABT1-68
gacatccagatgacccagtctccatcctccctgtctgcatctgtaggagaccgtgtcaccatcacttgccgggcaagtcagagcattcataagcagttaacgtggtaccagcagaaaccagggaaagcccctaagctcctgatctatagggcatcccggttgcaaagtggggtcccatcacgtttcagtggcagtggatctgggacagatttcactctcaccatcagcagtctgcaacctgaagattttgctacgtactactgtcaacagtatcatcataggccttcaacgttcggccaagggaccaaggtggaaatcaaacgg

SEQ ID NO: 232 - DNA, 324 bp, Artificial Sequence
  Description of Artificial Sequence: Synthetic polynucleotide ABT1-82
gacatccagatgacccagtctccatcctccctgtctgcatctgtaggagaccgtgtcaccatcacttgccgggcaagtcagagcattgggaagtcgttacggtggtaccagcagaaaccagggaaagcccctaagctcctgatctatcgtgcatcctatttgcaaagtggggtcccatcacgtttcagtggcagtggatctgggacagatttcactctcaccatcagcagtctgcaacctgaagattttgctacgtactactgtcaacaggttatgtttgggcctcgtacgttcggccaagggaccaaggtggaaatcaaacgg

SEQ ID NO: 233 - DNA, 324 bp, Artificial Sequence
  Description of Artificial Sequence: Synthetic polynucleotide ABT1-95
gacatccagatgacccagtctccatcctccctgtctgcatctgtaggagaccgtgtcaccatcacttgccgggcaagtcagccgattcatgggaatttacgttggtatcagcagaaaccagggaaagcccctaagctcctgatctataatatttccaatttgcaaagtggggtcccatcacgtttcagtggcagtggatctgggacagatttcactctcaccatcagcagtctgcaacctgaagattttgctacgtactactgtcaacaggggtatcgttggcctgttacgttcggccaagggaccaaggtggaaatcaaacgg

SEQ ID NO: 234 - DNA, 324 bp, Artificial Sequence
  Description of Artificial Sequence: Synthetic polynucleotide ABT1-95-3
gacatccagatgacccagtctccatcctccctgtctgcatctgtaggagaccgtgtcaccatcacttgccgggcaagtcagccgattcatgggaatttacgttggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 235 - DNA, 324 bp, Artificial Sequence
  Description of Artificial Sequence: Synthetic polynucleotide ABT1-95-4
gacatccagatgacccagtctccatcctccctgtctgcatctgtaggagaccgtgtcaccatcacttgccgggcaagtcagccgattgtgcgcaacttaaggtggtatcagcagaaaccagggaaagcccctaagctcctgatctattcttcgtcctatttgcaaagtggggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 236 - DNA, 324 bp, Artificial Sequence
  Description of Artificial Sequence: Synthetic polynucleotide ABT1-95-6
gacatccagatgacccagtcaccatcctctctgtctgcatctgtaggagaccgtgtcaccatcacttgccgggcaagtcagccgattcaggggaatttacgttggtatcagcagaaaccagggaaggcccctaagctcctgatctattcttcgtcctatttggaaagtggggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 237 - DNA, 324 bp, Artificial Sequence
  Description of Artificial Sequence: Synthetic polynucleotide ABT1-95-8
gacatccagatgacccagtcaccatcctctctgtctgcatctgtaggagaccgtgtcaccatcacttgccgggcaagtcagccgattcaggggaatttacgttggtatcagcagaaaccagggaaagcccctaagctcctgatctattcttcgtcctatttggaaagaggggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 238 - DNA, 324 bp, Artificial Sequence
  Description of Artificial Sequence: Synthetic polynucleotide ABT1-95-9
gacatccagatgacccagtcaccatcctctctgtctgcatctgtaggagaccgtgtcaccatcacttgccgggcaagtcagccgattcaggggaatttacgttggtatcagcagaaaccagggaaagcccctaagctcctgatctattcttcgtcctatttggaaagaggggtcccatcacgtttcagtggtagtggatccgggacagatttcactctcaccatcagcagtctgcatcctgaagattttgctacgtaccactgtcaacaggggtatcgttggcctgttacgttcggccaagggaccaaggtggaaatcaaacgg

SEQ ID NO: 239 - DNA, 324 bp, Artificial Sequence
  Description of Artificial Sequence: Synthetic polynucleotide ABT1-95-10
gacatccagatgacccagtcaccatcctctctgtctgcatctgtaggagaccgtgtcaccatcacttgccgggcaagtcagccgattcaggggaatttacgttggtatcagcagaaaccagggaaagcccctaagctcctgatctattcttcgtcctatttggaaagaggggtcccatcacgtttcagtggtagtggatccgggacagatttcactctcaccatcagcagtctgcatcctgaagatcttgctacgtaccactgtcaacaggggtatcgttggcctgttacgttcggccaagggaccaaggtggaaatcaaacgg

SEQ ID NO: 240 - DNA, 324 bp, Artificial Sequence
  Description of Artificial Sequence: Synthetic polynucleotide ABT1-95-11
gacatccagatgacccagtcaccatcctctctgtctgcatctgtaggagaccgtgtcaccatcacttgccgggcaagtcagccgattcaggggaatttacgttggtatcagcagaaaccagggatagcccctaagctcctgatctattcttcgtcctatttggaaagaggggtcccatcacgtttcagtggtagtggatccgggacagatttcactctcaccatcagcagtctgcatcctgaagatcttgctacgtaccactgtcaacaggggtatcgttggcctgttacgttcggccaagggaccaaggtggaaatcaaacgg

SEQ ID NO: 241 - DNA, 324 bp, Artificial Sequence
  Description of Artificial Sequence: Synthetic polynucleotide ABT1-95-12
gacatccagatgacccagtctccatcctccctgtctgcatctgtaggagaccgtgtcaccatcacttgccgggcaagtcagccgattcatgggaatttacgttggtatcagcagaaaccagggaaagcccctaagctcctgatctattcttcgtcctatttggaaagttgggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 242 - DNA, 324 bp, Artificial Sequence
  Description of Artificial Sequence: Synthetic polynucleotide ABT1-95-13
gacatccagatgacccagtctccatcctccctgtctgcatctgtaggagaccgtgtcaccatcacttgccgggcaagtcagccgattgtgcgcaacttaaggtggtatcagcagaaaccagggaaagcccctaagctcctgatctattcttcgtcctatttggaaagaggggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 243 - DNA, 324 bp, Artificial Sequence
  Description of Artificial Sequence: Synthetic polynucleotide ABT1-95-14
gacatccagatgacccagtctccatcctccctgtctgcatctgtaggagaccgtgtcaccatcacttgccgggcaagtcagccgattgtgaagaacttaaggtggtatcagcagaaaccagggaaagcccctaagctcctgatctattcttcgtcctatttggaaagaggggtcccatcacgtttcagtggtagtggatccgggacagatttcactctcaccatcagcagtctgcaacctgaagattttgctacgtaccactgtcaacaggggtatcgttggcctgttacgttcggccaagggaccaaggtggaaatcaaacgg

SEQ ID NO: 244 - DNA, 324 bp, Artificial Sequence
  Description of Artificial Sequence: Synthetic polynucleotide ABT1-95-15
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 245 - DNA, 324 bp, Artificial Sequence
  Description of Artificial Sequence: Synthetic polynucleotide ABT1-95-21
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtatcgttggcctgttacgttcggccaagggaccaaggtggaaatcaaacgg

SEQ ID NO: 246 - DNA, 324 bp, Artificial Sequence
  Description of Artificial Sequence: Synthetic polynucleotide ABT1-95-22
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtatcactggcctgttacgttcggccaagggaccaaggtggaaatcaaacgg

SEQ ID NO: 247 - DNA, 324 bp, Artificial Sequence
  Description of Artificial Sequence: Synthetic polynucleotide ABT1-95-23
gacatccagatgacccagtctccatcctccctgtctgcatctgtaggagaccgtgtcaccatcacttgccgggcaagtcagccgactgtgcggaacctaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtaccgttggcctgttacgttcggccaagggaccaaggtggaaatcaaacgg

SEQ ID NO: 248 - DNA, 324 bp, Artificial Sequence
  Description of Artificial Sequence: Synthetic polynucleotide ABT1-95-24
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgttgccaggggtatcgttggcctgttacgttcggccaagggaccaaggtggaaatcaaacgg

SEQ ID NO: 249 - DNA, 324 bp, Artificial Sequence
  Description of Artificial Sequence: Synthetic polynucleotide ABT1-95-25
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtgaccaggggtatcgttggcctgttacgttcggccaagggaccaaggtggaaatcaaacgg

SEQ ID NO: 250 - DNA, 324 bp, Artificial Sequence
  Description of Artificial Sequence: Synthetic polynucleotide ABT1-95-26
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtggccaggggtatcgttggcctgttacgttcggccaagggaccaaggtggaaatcaaacgg

SEQ ID NO: 251 - DNA, 324 bp, Artificial Sequence
  Description of Artificial Sequence: Synthetic polynucleotide ABT1-95-27
gacatccagatgacccagtctccatcctccctgtctgcatctgtaggagaccgtgtcaccatcacttgccgggcaagtcagccgattgtgcggaacttaaggtggtatcagcagaaaccaaggaaagcccctaagctcctgatctattcttcgtcctatttggagcccggggtcccatcacgtttcagtggtagtggatccgggacagatttcactctcaccatcagcagtctgcaacccgaagattttgctacgtactactgtgcgcaggggtatcgttggcctgttacgttcggccaagggaccaaggtggaaatcaaacgg

SEQ ID NO: 252 - DNA, 324 bp, Artificial Sequence
  Description of Artificial Sequence: Synthetic polynucleotide ABT1-95-28
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtatggctggcctgttacgttcggccaagggaccaaggtggaaatcaaacgg

SEQ ID NO: 253 - DNA, 324 bp, Artificial Sequence
  Description of Artificial Sequence: Synthetic polynucleotide ABT1-95-29
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtatcagtggcctgttacgttcggccaagggaccaaggtggaaatcaaacgg

SEQ ID NO: 254 - DNA, 324 bp, Artificial Sequence
  Description of Artificial Sequence: Synthetic polynucleotide ABT1-95-30
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacagtcctatcgttggcctgttacgttcggccaagggaccaaggtggaaatcaaacgg

SEQ ID NO: 255 - DNA, 324 bp, Artificial Sequence
  Description of Artificial Sequence: Synthetic polynucleotide ABT1-95-31
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtatctgtggcctgttacgttcggccaagggaccaaggtggaaatcaaacgg

SEQ ID NO: 256 - DNA, 324 bp, Artificial Sequence
  Description of Artificial Sequence: Synthetic polynucleotide ABT1-95-32
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcaacaggggtattcctggcctgttacgttcggccaagggaccaaggtggaaatcaaacgg

SEQ ID NO: 257 - DNA, 324 bp, Artificial Sequence
  Description of Artificial Sequence: Synthetic polynucleotide ABT1-95-33
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtactactgtcgccaggggtatcgttggcctgttacgttcggccaagggaccaaggtggaaatcaaacgg

SEQ ID NO: 258 - DNA, 324 bp, Artificial Sequence
  Description of Artificial Sequence: Synthetic polynucleotide ABT1-95-34
gacatccagatgacccagtctccatcctccctgtctgcatctgtaggagaccgtgtcaccatcacttgccgggcaagtgcgccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 259 - DNA, 324 bp, Artificial Sequence
  Description of Artificial Sequence: Synthetic polynucleotide ABT1-95-35
gacatccagatgacccagtctccatcctccctgtctgcatctgtaggagaccgtgtcaccatcacttgccgggcaagtgggccgattgtgcggaacttaaggtggtatcagcagaaaccaggaaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 260 - DNA, 324 bp, Artificial Sequence
  Description of Artificial Sequence: Synthetic polynucleotide ABT1-95-36
gacatccagatgacccagtctccatcctccctgtctgcatctgtaggagaccgtgtcgccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 261 - DNA, 324 bp, Artificial Sequence; identical to SEQ ID NO: 244
  Description of Artificial Sequence: Synthetic polynucleotide ABT1-95-37

SEQ ID NO: 262 - DNA, 324 bp, Artificial Sequence
  Description of Artificial Sequence: Synthetic polynucleotide ABT1-95-38
gacatccagatgacccagtctccatcctccctgcctgcatctgtaggagaccgtgtcaccatcacttgccgggcaagtcagccgattgtgcggaacttaaggtggtatcagcagaaaccagggaaagcccccaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 263 - DNA, 324 bp, Artificial Sequence
  Description of Artificial Sequence: Synthetic polynucleotide ABT1-95-39
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcggtctgcaacccgaagattttgctacgtaccactgtcaacaggggtatcgttggcctgttacgttcggccaagggaccaaggtggaaatcaaacgg

SEQ ID NO: 264 - DNA, 324 bp, Artificial Sequence
  Description of Artificial Sequence: Synthetic polynucleotide ABT1-95-40
gacatccagatgacccagtctccatcctccctgtctgcatctgtaggagaccgtgtcaccatcacttgccgggcaagtcccccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 265 - DNA, 324 bp, Artificial Sequence
  Description of Artificial Sequence: Synthetic polynucleotide ABT1-95-41
gacatccagatgacccagtctccatcctccctgtctgcatctgtaggagaccgtgtcaccatcacttgccgggcaagttacccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 266 - DNA, 324 bp, Artificial Sequence
  Description of Artificial Sequence: Synthetic polynucleotide ABT1-95-42
gacatccagatgacccagtctccatcctccctgtctgcatctgtaggagaccgtgtcaccatcacttgccgggcaagtttcccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgccacgtaccactgtcaacaggggtatcgttggcctgttacgttcggccaagggaccaaggtggaaatcaaacgg

SEQ ID NO: 267 - DNA, 324 bp, Artificial Sequence
  Description of Artificial Sequence: Synthetic polynucleotide ABT1-95-43
gacatccagatgacccagtctccatcctccctgtctgcatctgtaggagaccgtgtcaccatcacttgccgggcaagtctcccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 268 - DNA, 324 bp, Artificial Sequence
  Description of Artificial Sequence: Synthetic polynucleotide ABT1-95-44
gacatccagatgacccagtctccatcctccctgtctgcatctgtaggagaccgtgtcaccattacttgccgggcaagttccccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 269 - DNA, 324 bp, Artificial Sequence
  Description of Artificial Sequence: Synthetic polynucleotide ABT1-95-45
gacatccagatgacccagtctccatcctccctgtctgcatctgtaggagaccgtgtcaccatcacttgccgggcaagtcccccgattgtgcggaacttaaggtggtatcagcagaaaccagggaaagcccctaagctcctgatctattcttcgtcctatttggagcccggggtcccatcacgtttcagtggtagtggatccgggacaaatttcactctcaccatcagcagtctgcaacccgaagattttgctacgtaccactgtcaacaggggtatcgttggcctgttacgttcggccaagggaccaaggtggaaatcaaacgg

SEQ ID NO: 270 - DNA, 324 bp, Artificial Sequence
  Description of Artificial Sequence: Synthetic polynucleotide ABT1-95-46
gacatccagatgacccagtctccatcctccctgtctgcatctgtaggagaccgtgtcaccatcacttgccgggcaagttcgccgattgtgcagaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 271 - DNA, 324 bp, Artificial Sequence
  Description of Artificial Sequence: Synthetic polynucleotide ABT1-95-47
gacatccagatgacccagtctccatcctccctgtctgcatctgtaggagaccgtgtcaccatcacttgccgggcaagtatgccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 272 - DNA, 324 bp, Artificial Sequence; identical to SEQ ID NO: 244
  Description of Artificial Sequence: Synthetic polynucleotide ABT1-95-48

SEQ ID NO: 273 - DNA, 324 bp, Artificial Sequence
  Description of Artificial Sequence: Synthetic polynucleotide ABT1-95-49
gacatccagatgacccagtctccatcctccctatctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 274 - DNA, 324 bp, Artificial Sequence
  Description of Artificial Sequence: Synthetic polynucleotide ABT1-95-50
gacatccagatgacccagtctccatcctccctgtctgcatctgtaggagaccgtgtcaccatcacttgccgggcaagtcagccgattccgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 275 - DNA, 324 bp, Artificial Sequence
  Description of Artificial Sequence: Synthetic polynucleotide ABT1-95-51
gacatccagatgacccagtctccatcctccctgtctgcatctgtaggagaccgtgtcaccatcacttgccgggcaagtcagccgattatccggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 276 - DNA, 324 bp, Artificial Sequence
  Description of Artificial Sequence: Synthetic polynucleotide ABT1-95-52
gacatccagatgacccagtctccatcctccctgtctgcatctgtaggagaccgtgtcaccatcacttgccgggcaagtcagccgattgtgtcgaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 277 - DNA, 324 bp, Artificial Sequence
  Description of Artificial Sequence: Synthetic polynucleotide ABT1-95-53
gacatccagatgacccagtctccatcctccctgtctgcatctgtaggagaccgtgtcaccatcacttgccgggcaagtcagccgattgtggccaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 278 - DNA, 324 bp, Artificial Sequence
  Description of Artificial Sequence: Synthetic polynucleotide ABT1-95-54
gacatccagatgacccagtctccatcctccctgtctgcatctgtaggagaccgtgtcaccatcacttgccgggcaagtcagccgattgtgaccaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 279 - DNA, 324 bp, Artificial Sequence
  Description of Artificial Sequence: Synthetic polynucleotide ABT1-95-55
gacatccagatgacccagtctccatcctccctgtctgcatctgtaggagaccgtgtcaccatcacttgccgggcaagtcagccgattgtgcacaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 280 - DNA, 324 bp, Artificial Sequence
  Description of Artificial Sequence: Synthetic polynucleotide ABT1-95-56
gacatccagatgacccagtctccatcctccctgtctgcatctgtaggagaccgtgtcaccatcacttgccgggcaagtcagccgattgtgcgcaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 281 - DNA, 324 bp, Artificial Sequence
  Description of Artificial Sequence: Synthetic polynucleotide ABT1-95-57
gacatccagatgacccagtctccatcctccctgtctgcatctgtaggagaccgtgtcaccatcacttgccgggcaagtcagccgattgtggagaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 282 - DNA, 324 bp, Artificial Sequence
  Description of Artificial Sequence: Synthetic polynucleotide ABT1-95-58
gacatccagatgacccagtctccatcctccctgtctgcatctgtaggagaccgtgtcaccatcacttgccgggcacgtcagccgattgtgtcgaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 283 - DNA, 324 bp, Artificial Sequence
  Description of Artificial Sequence: Synthetic polynucleotide ABT1-95-59
gacatccagatgacccagtctccatcctccctgtctgcatctgtaggagaccgtgtcaccatcacttgccgggcaagtcagccgattgtgaagaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 284 - DNA, 324 bp, Artificial Sequence
  Description of Artificial Sequence: Synthetic polynucleotide ABT1-95-60
gacatccagatgacccagtctccagcctccctgtctgcatctgtaggagaccgtgtcaccatcacttgccgggcaagtcagccgattgtggccaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 285 - DNA, 324 bp, Artificial Sequence
  Description of Artificial Sequence: Synthetic polynucleotide ABT1-95-61
gacatccagatgacccagtctccatcctccctgtctgcatctgtaggagaccgtgtcaccatcacttgccgggcaagtcagccgattgtgcggaacttacgctggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 286 - DNA, 324 bp, Artificial Sequence
  Description of Artificial Sequence: Synthetic polynucleotide ABT1-95-62
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctactcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 287 - DNA, 324 bp, Artificial Sequence
  Description of Artificial Sequence: Synthetic polynucleotide ABT1-95-63
gacatccagatgacccagtctccatcctccctgtctgcatctgtaggagaccgtgtcaccatcacttgccgggcaagtcagccgattgtgcggaacttaaggtggtatcagcagaaactagggaaagcccctaagctcctgatcttctcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 288 - DNA, 324 bp, Artificial Sequence
  Description of Artificial Sequence: Synthetic polynucleotide ABT1-95-64
gacatccagatgacccagtccccatcctccctgtctgcatctgtaggagaccgtgtcaccatcacttgccgggcaagtcagccgattgtgcggaacttaaggtggtatcagcagaaaccagggaaagcccctaagctcctggtccactcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaagtcaaacgg

SEQ ID NO: 289 - DNA, 324 bp, Artificial Sequence
  Description of Artificial Sequence: Synthetic polynucleotide ABT1-95-65
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctatggctcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 290 - DNA, 324 bp, Artificial Sequence
  Description of Artificial Sequence: Synthetic polynucleotide ABT1-95-66
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctggtctatttctcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 291 - DNA, 324 bp, Artificial Sequence
  Description of Artificial Sequence: Synthetic polynucleotide ABT1-95-67
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctatgcgtcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 292 - DNA, 324 bp, Artificial Sequence
  Description of Artificial Sequence: Synthetic polynucleotide ABT1-95-68
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcgtcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 293 - DNA, 324 bp, Artificial Sequence
  Description of Artificial Sequence: Synthetic polynucleotide ABT1-95-69
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctataagtcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 294 - DNA, 324 bp, Artificial Sequence
  Description of Artificial Sequence: Synthetic polynucleotide ABT1-95-70
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctggtctatggctcgtcctatttggagcccggggtcccatcacgtttcagtggtagtggatctgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 295 - DNA, 324 bp, Artificial Sequence
  Description of Artificial Sequence: Synthetic polynucleotide ABT1-95-71
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctataactcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 296 - DNA, 324 bp, Artificial Sequence
  Description of Artificial Sequence: Synthetic polynucleotide ABT1-95-72
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctatcactcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 297 - DNA, 324 bp, Artificial Sequence
  Description of Artificial Sequence: Synthetic polynucleotide ABT1-95-73
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctatcagtcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 298 - DNA, 324 bp, Artificial Sequence
  Description of Artificial Sequence: Synthetic polynucleotide ABT1-95-74
gacatccagatgacccagtctccatcctccctgtctgcatctgtaggagaccgtgtcaccatcacttgccgggcaagtcagccgattgtgcggaacttaaggtggtatcagcagagaccagggaaagcccctaagctcctgatctattctgggtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 299 - DNA, 324 bp, Artificial Sequence
  Description of Artificial Sequence: Synthetic polynucleotide ABT1-95-75
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctgcctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 300 - DNA, 324 bp, Artificial Sequence
  Description of Artificial Sequence: Synthetic polynucleotide ABT1-95-76
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctggctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 301 - DNA, 324 bp, Artificial Sequence
  Description of Artificial Sequence: Synthetic polynucleotide ABT1-95-77
gacatccagatgacccagtctccatcctccctgtctgcatctgtaggagaccgtgtcaccatcacttgccgggcaagtcagccgattgtgcggaacttaaggtggtatcagcagaaaccagggaaagcccctgagctcctgatctattctggctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 302 - DNA, 324 bp, Artificial Sequence
  Description of Artificial Sequence: Synthetic polynucleotide ABT1-95-78
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctgagtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 303 - DNA, 324 bp, Artificial Sequence
  Description of Artificial Sequence: Synthetic polynucleotide ABT1-95-79
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctagctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 304 - DNA, 324 bp, Artificial Sequence
  Description of Artificial Sequence: Synthetic polynucleotide ABT1-95-80
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctgtgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 305 - DNA, 324 bp, Artificial Sequence
  Description of Artificial Sequence: Synthetic polynucleotide ABT1-95-81
gacatccagatgacccagtctccatccttcctgtctgcatctgtaggagaccgtgtcaccatcacttgccgggcaagtcagccgattgtgcggaacttaaggtggtatcagcagaaaccagggaaagcccctaagctcctgatctattctagctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 306 - DNA, 324 bp, Artificial Sequence
  Description of Artificial Sequence: Synthetic polynucleotide ABT1-95-82
gacatcccgatgacccagtctccatcctccctgtctgcatctgtaggagaccgtgtcactatcacttgccgggcaagtcagccgattgtgcggaacttaaggtggtatcagcagaaaccagggaaagcccctaagctcctgatctattctacctcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 307 - DNA, 324 bp, Artificial Sequence
  Description of Artificial Sequence: Synthetic polynucleotide ABT1-95-83
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccaccacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 308 - DNA, 324 bp, Artificial Sequence
  Description of Artificial Sequence: Synthetic polynucleotide ABT1-95-84
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttggtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 309 - DNA, 324 bp, Artificial Sequence
  Description of Artificial Sequence: Synthetic polynucleotide ABT1-95-85
gacatccagatgacccagtctccatcctccctgtctgcatctgtaggagaccgtgtcaccatcacttgccgggcaggtcagccgattgtgcggaacttaaggtggtatcagcagaaaccagggaaagcccctaagctcctgatctattctgggtcctatttggagcccggggtcccatcacgtttcagtggtagtggatccgggacagatttcactctcaccatcagcagtctgcaacccgaagattttgctacgtaccactgtctacaggggtatcgttggcctgttacgttcggccaagggaccaaggtggaaatcaaacgg

SEQ ID NO: 310 - DNA, 324 bp, Artificial Sequence
  Description of Artificial Sequence: Synthetic polynucleotide ABT1-95-86
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctacgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 311 - DNA, 324 bp, Artificial Sequence
  Description of Artificial Sequence: Synthetic polynucleotide ABT1-95-87
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcccggttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 312 - DNA, 324 bp, Artificial Sequence
  Description of Artificial Sequence: Synthetic polynucleotide ABT1-95-88
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctacttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 313 - DNA, 324 bp, Artificial Sequence
  Description of Artificial Sequence: Synthetic polynucleotide ABT1-95-89
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtccctcttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 314 - DNA, 324 bp, Artificial Sequence
  Description of Artificial Sequence: Synthetic polynucleotide ABT1-95-90
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcccagttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 315 - DNA, 324 bp, Artificial Sequence
  Description of Artificial Sequence: Synthetic polynucleotide ABT1-95-91
gacatccagatgacccagtctccatcctccctgtctgcatctgtaggagaccgtgtcaccatcacttgccgggcgagtcagccgattgtgcggaacttaaggtggtatcagcagaaaccagggaaagcccctaagctcctgatctattcttcgtccaatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 316 - DNA, 324 bp, Artificial Sequence
  Description of Artificial Sequence: Synthetic polynucleotide ABT1-95-92
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtccaccttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 317 - DNA, 324 bp, Artificial Sequence
  Description of Artificial Sequence: Synthetic polynucleotide ABT1-95-93
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtccatcttggagcccggggtcccatcacgtttcagtggtggtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 318 - DNA, 324 bp, Artificial Sequence
  Description of Artificial Sequence: Synthetic polynucleotide ABT1-95-94
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctccttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 319 - DNA, 324 bp, Artificial Sequence
  Description of Artificial Sequence: Synthetic polynucleotide ABT1-95-95
gacatccagatgatccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcccagttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 320 - DNA, 324 bp, Artificial Sequence
  Description of Artificial Sequence: Synthetic polynucleotide ABT1-95-96
gacatccagatgacccagtctccatcctccctgtctgcatctgtaggagaccgtgtcaccatcgcttgccgggcaagtcagccgattgtgcggaacttaaggtggtatcagcagaaaccagggaaagcccctaagctcctgatctattcttcgtccaggttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 321 - DNA, 324 bp, Artificial Sequence
  Description of Artificial Sequence: Synthetic polynucleotide ABT1-95-97
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtccttcttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 322 - DNA, 324 bp, Artificial Sequence
  Description of Artificial Sequence: Synthetic polynucleotide ABT1-95-98
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtccgcgttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 323 - DNA, 324 bp, Artificial Sequence
  Description of Artificial Sequence: Synthetic polynucleotide ABT1-95-99
gacatccagatgacccagtctccatcctccctgtctgcatctgtaggagaccgtgtctccatcacttgccgggcaagtcagccgattgtgcggaacttaaggtggtatcagcagaaaccagggaaagcccctaagctcctgatctattcttcgtccacgttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 324 - DNA, 324 bp, Artificial Sequence
  Description of Artificial Sequence: Synthetic polynucleotide ABT1-95-100
gacatccagatgacccagtctccatcctccctgtctgcatctgtaggagaccgtgtcaccatcacttgccgggcaagtcggccgattgtgcggaacttaaggtggtatcagcagaaaccagggaaagcccctaagctcctgatctattcttcgtccctcttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 325 - DNA, 324 bp, Artificial Sequence
  Description of Artificial Sequence: Synthetic polynucleotide ABT1-95-101
gacatccagatgacccagtctccatcctccctgtctgcatccgtaggagaccgtgtcaccatcacttgccgggcgagtcagccgattgtgcggaacttaaggtggtatcagcagaaaccagggaaagcccctaagctcctggtctattcttcgtccctcttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 326 - DNA, 324 bp, Artificial Sequence
  Description of Artificial Sequence: Synthetic polynucleotide ABT1-95-102
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttgcagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 327 - DNA, 324 bp, Artificial Sequence
  Description of Artificial Sequence: Synthetic polynucleotide ABT1-95-103
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagaagggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 328 - DNA, 324 bp, Artificial Sequence
  Description of Artificial Sequence: Synthetic polynucleotide ABT1-95-104
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagtccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 329 - DNA, 324 bp, Artificial Sequence
  Description of Artificial Sequence: Synthetic polynucleotide ABT1-95-105
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcgcggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 330 - DNA, 324 bp, Artificial Sequence
  Description of Artificial Sequence: Synthetic polynucleotide ABT1-95-106
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagaggggggtcccatcacgtttcagtggtagtggatccgggacagatttcactctcaccatcagcagtctgcaacccgaagattttgctacgtaccactgtcaacaggggtatcgttggcctgttgcgttcggccaagggaccaaggtggaaatcaaacgg

SEQ ID NO: 331 - DNA, 324 bp, Artificial Sequence
  Description of Artificial Sequence: Synthetic polynucleotide ABT1-95-107
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcacggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 332 - DNA, 324 bp, Artificial Sequence
  Description of Artificial Sequence: Synthetic polynucleotide ABT1-95-108
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggaggagggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 333 - DNA, 324 bp, Artificial Sequence
  Description of Artificial Sequence: Synthetic polynucleotide ABT1-95-109
gacatccagatgacccagtctccatcctccctgtctgcatctgtaggagaccgtgtcaccatcacttgccgggcaaatcagccgattgtgcggaacttaaggtggtatcagcagaaaccagggaaagcccctaagctcctgatctattcttcgtcctatttggagaacggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 334 - DNA, 324 bp, Artificial Sequence
  Description of Artificial Sequence: Synthetic polynucleotide ABT1-95-110
gacatccagatgacccagtcaccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggaggcgggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 335 - DNA, 324 bp, Artificial Sequence
  Description of Artificial Sequence: Synthetic polynucleotide ABT1-95-111
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggaggacggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 336 - DNA, 324 bp, Artificial Sequence
  Description of Artificial Sequence: Synthetic polynucleotide ABT1-95-112
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagaacggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 337 - DNA, 324 bp, Artificial Sequence; identical to SEQ ID NO: 244
  Description of Artificial Sequence: Synthetic polynucleotide ABT1-95-113

SEQ ID NO: 338 - DNA, 324 bp, Artificial Sequence
  Description of Artificial Sequence: Synthetic polynucleotide ABT1-95-114
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggaggtgggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 339 - DNA, 324 bp, Artificial Sequence
  Description of Artificial Sequence: Synthetic polynucleotide ABT1-95-115
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtttgcaggggtatcgttggcctgttacgttcggccaagggaccaaggtggaaatcaaacgg

SEQ ID NO: 340 - DNA, 324 bp, Artificial Sequence
  Description of Artificial Sequence: Synthetic polynucleotide ABT1-95-116
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtgtgcaggggtatcgttggcctgttacgttcggccaagggaccaaggtggaaatcaaacgg

SEQ ID NO: 341 - DNA, 324 bp, Artificial Sequence
  Description of Artificial Sequence: Synthetic polynucleotide ABT1-95-117
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctatgtaccactgtgtccaggggtatcgttggcctgttacgttcggccaagggaccaaggtggaaatcaaacgg

SEQ ID NO: 342 - DNA, 324 bp, Artificial Sequence
  Description of Artificial Sequence: Synthetic polynucleotide ABT1-95-118
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgttcgcaggggtatcgttggcctgttacgttcggccaagggaccaaggtggaaatcaaacgg

SEQ ID NO: 343 - DNA, 324 bp, Artificial Sequence
  Description of Artificial Sequence: Synthetic polynucleotide ABT1-95-119
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtgagcaggggtatcgttggcctgttacgttcggccaagggaccaaggtggaaatcaaacgg

SEQ ID NO: 344 - DNA, 324 bp, Artificial Sequence
  Description of Artificial Sequence: Synthetic polynucleotide ABT1-95-120
gacatccagatgacccagtctccatcctccctgtctgcatctgtaggagaccgtgtcaccatcacttgccgggcaagtcagccgattgcgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggtgtatcgttggcctgttacgttcggccaagggaccaaggtggaaatcaaacgg

SEQ ID NO: 345 - DNA, 324 bp, Artificial Sequence
  Description of Artificial Sequence: Synthetic polynucleotide ABT1-95-121
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatgagtggcctgttacgttcggccaagggaccaaggtggaaatcaaacgg

SEQ ID NO: 346 - DNA, 324 bp, Artificial Sequence
  Description of Artificial Sequence: Synthetic polynucleotide ABT1-95-122
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcattctcaccatcagcagtctgcaacccgaagattttgctacgtaccactgtcaacaggggtatcgttggcctgttacgttcggccaagggaccaaggtggaaatcaaacgg

SEQ ID NO: 347 - DNA, 324 bp, Artificial Sequence
  Description of Artificial Sequence: Synthetic polynucleotide ABT1-95-123
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatgcgtggcctgttacgttcggccaagggaccaaggtggaaatcaaacgg

SEQ ID NO: 348 - DNA, 324 bp, Artificial Sequence
  Description of Artificial Sequence: Synthetic polynucleotide ABT1-95-124
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatatgtggcctgttacgttcggccaagggaccaaggtggaaatcaaacgg

SEQ ID NO: 349 - DNA, 324 bp, Artificial Sequence
  Description of Artificial Sequence: Synthetic polynucleotide ABT1-95-125
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctctgacgttcggccaagggaccaaggtggaaatcaaacgg

SEQ ID NO: 350 - DNA, 324 bp, Artificial Sequence
  Description of Artificial Sequence: Synthetic polynucleotide ABT1-95-126
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggccttcgacgttcggccaagggaccaaggtggaaatcaaacgg

SEQ ID NO: 351 - DNA, 324 bp, Artificial Sequence
  Description of Artificial Sequence: Synthetic polynucleotide ABT1-95-127
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcggcagtctgcaacccgaagattttgctacgtaccactgtcaacaggggtatcgttggcctattacgttcggccaagggaccaaggtggaaatcaaacgg

SEQ ID NO: 352 - DNA, 324 bp, Artificial Sequence
  Description of Artificial Sequence: Synthetic polynucleotide ABT1-95-128
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctggcacgttcggccaagggaccaaggtggaaatcaagcgg

SEQ ID NO: 353 - DNA, 324 bp, Artificial Sequence
  Description of Artificial Sequence: Synthetic polynucleotide ABT1-95-129
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaccccgaagatctagctacgtaccactgtcaacaggggtatcgttggcctgttacgttcggccaagggaccaaggtggaaatcaaacgg

SEQ ID NO: 354 - DNA, 324 bp, Artificial Sequence; identical to SEQ ID NO: 255
  Description of Artificial Sequence: Synthetic polynucleotide ABT1-95-130

SEQ ID NO: 355 - DNA, 324 bp, Artificial Sequence
  Description of Artificial Sequence: Synthetic polynucleotide ABT1-95-131
gacatccagatgacccagtctccatcctccctgtctgcatctgtaggagaccgtgtcaccatcacttgccgggcaagtcagccgactgtgcggaacctaaggtggtaccagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 356 - DNA, 324 bp, Artificial Sequence
  Description of Artificial Sequence: Synthetic polynucleotide ABT1-95-132
gacatccagatgacccagtctccatcctccctgtctgcatctgtaggagaccgtgtcaccatcacttgccgggcaagtcagccgattgtgcggaacttaaggtggtatcagcagaaaccagggatagcccctaagctcctgatctattcttcgtcctatttggagcccggggtcccatcacgtttcagtggtagtggatccgggacagatttcactctcaccatcagcagtccgcaacccgaagattttgctacgtaccactgtcaacaggggtatcgttggcctgttacgttcggccaagggaccaaggtggaaatcaaacgg

SEQ ID NO: 357 - DNA, 324 bp, Artificial Sequence
  Description of Artificial Sequence: Synthetic polynucleotide ABT1-95-133
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcgccaggggtatcgttggcctgttacgttcggccaagggaccaaggtggaaatcaaacgg

SEQ ID NO: 358 - DNA, 324 bp, Artificial Sequence
  Description of Artificial Sequence: Synthetic polynucleotide ABT1-95-134
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtgcccaggggtatcgttggcctgttacgttcggccaagggaccaaggtggaaatcaaacgg

SEQ ID NO: 359 - DNA, 324 bp, Artificial Sequence
  Description of Artificial Sequence: Synthetic polynucleotide ABT1-95-135
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtattcctggcctgttacgttcggccaagggaccaaggtggaaatcaaacgg

SEQ ID NO: 360 - DNA, 324 bp, Artificial Sequence
  Description of Artificial Sequence: Synthetic polynucleotide ABT1-95-136
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaccccgaagatctagctacgtaccactgtcaacaggggtatggctggcctgttacgttcggccaagggaccaaggtggaaatcaaacgg

SEQ ID NO: 361 - DNA, 324 bp, Artificial Sequence
  Description of Artificial Sequence: Synthetic polynucleotide ABT1-95-137
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatctgtggcctgttacgttcggccaagggaccaaggtggaaatcaaacgg

SEQ ID NO: 362 - DNA, 324 bp, Artificial Sequence
  Description of Artificial Sequence: Synthetic polynucleotide ABT1-95-139
gacatccagatgacccagtctccatcctccctgtctgcatctgtaggagaccgtgtcaccatcacttgccgggcaagtcagcagattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 363 - DNA, 324 bp, Artificial Sequence
  Description of Artificial Sequence: Synthetic polynucleotide ABT1-95-140
gacatccagatgacccagtctccatcctccctgtctgcatctgtaggagaccgtgtcaccatcacttgccgggcaagtcagggcattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 364 - DNA, 324 bp, Artificial Sequence
  Description of Artificial Sequence: Synthetic polynucleotide ABT1-95-141
gacatccagatgacccagtctccatcctccctgtctgcatctgtaggagaccgtgtcaccatcacttgccgggcaagtcagccgattttgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 365 - DNA, 324 bp, Artificial Sequence
  Description of Artificial Sequence: Synthetic polynucleotide ABT1-95-142
gacattcagatgacccagtctccatcctccctgtctgcatctgtaggagaccgtgtcaccatcacttgccgggcaagtcagccgattacccggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 366 - DNA, 324 bp, Artificial Sequence
  Description of Artificial Sequence: Synthetic polynucleotide ABT1-95-143
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatcacgtcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 367 - DNA, 324 bp, Artificial Sequence
  Description of Artificial Sequence: Synthetic polynucleotide ABT1-95-144
gacatccagatgacccagtctccatcctccctgtctgcatctgtaggagaccgtgtcaccatcacttgccgggcaagtcagccgattgtgcggaacttaaggtggtatcagcagaaacctgggaaagcccctaagctcctgatctattcttcgtcctatttgagccccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 368 - DNA, 324 bp, Artificial Sequence
  Description of Artificial Sequence: Synthetic polynucleotide ABT1-95-145
gacatccagatgacccagtctccatcctccctgtctgcatctgtaggagaccatgtcaccatcacttgccgggcaagtcagccgattgtgcggaacttaaggtggtatcagcagaaaccagggaaagcccctaagctcctgatctattcttcgtcctatttggtccccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 369 - DNA, 324 bp, Artificial Sequence
  Description of Artificial Sequence: Synthetic polynucleotide ABT1-95-146
gacatccagatgacccagtctccatcctccctgtctgcatctgtaggagaccgtgtcaccatcacttgccgggcaagtcagaacattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 370 - DNA, 324 bp, Artificial Sequence
  Description of Artificial Sequence: Synthetic polynucleotide ABT1-95-147
gacatccagatgacccagtctccatcctccctgtctgcatctgtaggagaccgtgtcaccatcacttgctgggcaagtcaggggattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 371 - DNA, 324 bp, Artificial Sequence
  Description of Artificial Sequence: Synthetic polynucleotide ABT1-95-148
gacatccagatgacccagtctccatcctccctgtctgcatctgtaggagaccgtgtcaccatcacttgccgggcaagtcagaccattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 372 - DNA, 324 bp, Artificial Sequence
  Description of Artificial Sequence: Synthetic polynucleotide ABT1-95-149
gacatccagatgacccagtctccatcctccctgtctgcatctgtaggagaccgtgtcaccatcacttgccgggcaagtcaggcgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 373 - DNA, 324 bp, Artificial Sequence
  Description of Artificial Sequence: Synthetic polynucleotide ABT1-95-150
gacatccagatgacccagtctccatcctccctgtctgcatctgtaggagaccgtgtcaccatcacttgccgggcaagtcagcacattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 374 - DNA, 324 bp, Artificial Sequence
  Description of Artificial Sequence: Synthetic polynucleotide ABT1-95-151
gacatccagatgacccagtctccatcctccctgtctgcatctgtaggagaccgtgtcaccatcacttgccgggcaggtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcgaccaagggaccaaggtggaaatcaaacgg

SEQ ID NO: 375 - DNA, 324 bp, Artificial Sequence
  Description of Artificial Sequence: Synthetic polynucleotide ABT1-95-152
gacatccagatgacccagtctccatcctccctgtctgcatctgtaggagaccgtgtcaccatcacttgccgggcaggtcagccgattccgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 376 - DNA, 324 bp, Artificial Sequence
  Description of Artificial Sequence: Synthetic polynucleotide ABT1-95-153
gacatccagatgacccagtctccatcctccctgtctgcatctgtaggagaccgtgtcaccatcacttgccgggcaagtcagccgattatccggaacttaaggtggtatcagcagaaaccagggaaagcccctaagctcctgatctattcttcgtcctatttggagcccggggtcccatcacgtttcagtggtagtggatccgggacaggtttcactctcaccatcagcagtctgcaacccgaagattttgctacgtaccactgtcaacaggggtatcgttggcctgttacgttcggccaagggaccaaggtggaaatcaaacgg

SEQ ID NO: 377 - DNA, 324 bp, Artificial Sequence
  Description of Artificial Sequence: Synthetic polynucleotide ABT1-95-154
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctcctcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 378 - DNA, 324 bp, Artificial Sequence
  Description of Artificial Sequence: Synthetic polynucleotide ABT1-95-155
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatcacctcttcgtcctatttggagcccggggtcccatcacgtttcagtggtagtggatccgggacagatttcactctcaccatcagcagtctgcaacccgaagattccgctacgtaccactgtcaacaggggtatcgttggcctgttacgttcggccaagggaccaaggtggaaatcaaacgg

SEQ ID NO: 379 - DNA, 324 bp, Artificial Sequence
  Description of Artificial Sequence: Synthetic polynucleotide ABT1-95-156
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatcgcctcttcgtcctatttggagcccggggtcccatcacgtttcagtggtagtggatccgggacagatttcactctcaccatcagcagtctgcaacccgaagattttgctacgtaccactgtctacaggggtatcgttggcctgttacgttcggccaagggaccaaggtggaaatcaaacgg

SEQ ID NO: 380 - DNA, 324 bp, Artificial Sequence
  Description of Artificial Sequence: Synthetic polynucleotide ABT1-95-157
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatcacgtcttcgtcctatttggagcccggggtcccatcacgtttcagtggtagtggatccggggcagatttcactctcaccatcagcagtctgcaacccgaagattttgctacgtaccactgtcaacaggggtatcgttggcctgttacgttcggccaagggaccaaggtggaaatcaaacgg

SEQ ID NO: 381 - DNA, 324 bp, Artificial Sequence
  Description of Artificial Sequence: Synthetic polynucleotide ABT1-95-158
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatcttctcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 382 - DNA, 324 bp, Artificial Sequence; identical to SEQ ID NO: 344
  Description of Artificial Sequence: Synthetic polynucleotide ABT1-95-159

SEQ ID NO: 383 - DNA, 324 bp, Artificial Sequence
  Description of Artificial Sequence: Synthetic polynucleotide ABT1-95-160
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcatcctatttggagcccggggtcccatcacgtttcagtggtagtggatccgggacagatttcactctcaccatcagcagtctgcaacccgaagattttgctacgtaccactgtcaacaggggtatgtgtggcctgttacgttcggccaagggaccaaggtggaaatcaaacgg

SEQ ID NO: 384 - DNA, 324 bp, Artificial Sequence
  Description of Artificial Sequence: Synthetic polynucleotide ABT1-95-161
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctccgacgttcggccaagggaccaaggtggaaatcaaacgg

SEQ ID NO: 385 - DNA, 324 bp, Artificial Sequence
  Description of Artificial Sequence: Synthetic polynucleotide ABT1-95-162
gacatccagatgacccagtctccatcctccctgtctgcatctgtaggagaccgtgtcaccatcacttgccgggcaagtaagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 386 - DNA, 324 bp, Artificial Sequence
  Description of Artificial Sequence: Synthetic polynucleotide ABT1-95-163
gacatccagatgacccagtctccatcctccctgtctgcatctgtaggagaccgtgtcaccatcacttgccgggcaagtaggccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggagatcaaacgg

SEQ ID NO: 387 - DNA, 324 bp, Artificial Sequence
  Description of Artificial Sequence: Synthetic polynucleotide ABT1-95-164
gacatccagatgacccagtctccatcctccctgtctgcatctgtaggagaccgtgtcaccatcacttgtcgggcaagtcagccgggagtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 388 - DNA, 324 bp, Artificial Sequence
  Description of Artificial Sequence: Synthetic polynucleotide ABT1-95-165
gacatccagatgacccagtctccatcctccctgtctgcatctgtaggagaccgtgtcaccatcacttgccgggcaagtcagccgattgtgcggaacatgaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 389 - DNA, 324 bp, Artificial Sequence
  Description of Artificial Sequence: Synthetic polynucleotide ABT1-95-166
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctaagtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 390 - DNA, 324 bp, Artificial Sequence
  Description of Artificial Sequence: Synthetic polynucleotide ABT1-95-167
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctcggtcctatttggagcccggggtcccatcacgtttcagtggtagtggatccggggcagatttcactctcaccatcagcagtctgcaacccgaagattttgctacgtaccactgtcaacaggggtatcgttggcctgttacgttcggccaagggaccaaggtggaaatcaaacgg

SEQ ID NO: 391 - DNA, 324 bp, Artificial Sequence
  Description of Artificial Sequence: Synthetic polynucleotide ABT1-95-168
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctttttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 392 - DNA, 324 bp, Artificial Sequence
  Description of Artificial Sequence: Synthetic polynucleotide ABT1-95-169
gacatccagatgacccagtctccatcctccctgtctgcatctgtaggagaccgtgtcaccatcacttgccgggcaagtcagccgattgtgcggaacttaaggtggtatcagcagaaaccagggaaagctcctaagctcctgatctatgcagtgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 393 - DNA, 324 bp, Artificial Sequence
  Description of Artificial Sequence: Synthetic polynucleotide ABT1-95-170
gacatccagatgacccagtctccatcctccctgtctgcatctgtaggagaccgtgtcaccatcacttgccgggcaagtaggccgattgtgcggaacttaaggtggtatcagcagaaaccagggaaagcccctaagctcctgatctatgcgtcgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 394 - DNA, 324 bp, Artificial Sequence
  Description of Artificial Sequence: Synthetic polynucleotide ABT1-95-171
gacatccagatgacccagtctccatcctccctgtctgcatctgtaggagaccgtgtcaccatcacttgccgggcaagtaggccgattgtgcggaacttaaggtggtatcagcagaaaccagggaaagcccctaagctcctgatctattctgtgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 395 - DNA, 324 bp, Artificial Sequence
  Description of Artificial Sequence: Synthetic polynucleotide ABT1-95-172
gacatccagatgacccagtctccatcctccctgtctgcatctgtaggagaccgtgtcaccatcacttgccgggcaagtaggccgattgtgcggaatttaaggtggtatcagcagaaaccagggaaagctcctaagctcctgatctatgcagtgtcctatttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgg

SEQ ID NO: 396 - DNA, 324 bp, Artificial Sequence
  Description of Artificial Sequence: Synthetic polynucleotide ABT1-95-173
gacatccagatgacccagtctccatcctccctgtctgcatctgtaggagaccgtgtcaccatctcttgccgggcaagtaggccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcgccaggggtatcgttggcctgttacgttcggccaagggaccaaggtggaaatcaaacgg

SEQ ID NO: 397 - DNA, 324 bp, Artificial Sequence
  Description of Artificial Sequence: Synthetic polynucleotide ABT1-95-174
gacatccagatgacccagtctccatcctccctatctgcatctgtaggagaccgtgtcaccatcacttgccgggcaagtaggccgattgtgcggaacttaaggtggtatcagcagaaaccagggaaagcccctaagctcctgatctattctgtgtcctatttggagcccggggtcccatcacgtttcagtggtagtggatccgggacagatttcactctcaccatcagcagtctgcaacccgaagattttgctacgtaccactgtcggcaggggtatcgttggcctgttacgttcggccaagggaccaaggtggaaatcaaacgg

SEQ ID NO: 398 - DNA, 324 bp, Artificial Sequence
  Description of Artificial Sequence: Synthetic polynucleotide ABT1-95-175
gacatccagatgacccagtctccatcctccctgtctgcatctgtaggagaccgtgtcaccatcacttgccgggcaagtaggccgattgtgcggaacttaaggtggtatcagcagaaaccagggaaagcccctaagctcctgatctatgcgtcgtcctatttggagcccggggtcccatcacgtttcagtggtagtggatccgggacagatttcactctcaccatcagcagtctgcaacccgaagattttgctacgtaccactgtcggcaggggtatcgttggcctgttacgttcggccaagggaccaaggtggaaatcaaacgg

SEQ ID NO: 399 - DNA, 324 bp, Artificial Sequence
  Description of Artificial Sequence: Synthetic polynucleotide ABT1-95-176
gacatccagatgacccagtctccatcctccctgtctgcatctgtaggagaccgtgtcaccatcacttgccgggcaagtaggccaattgtgcggaacttaaggtggtatcagcagaaaccagggaaagctcctaagctcctgatctatgcagtgtcctatttggagcccggggtcccatcacgtttcagtggtagtggatccgggacagatttcactctcaccatcagcagtctgcaacccgaagattttgctacgtaccactgtcggcaggggtatcgttggcctgttacgttcggccaagggaccaaggtggaaatcaaacgg

SEQ ID NO: 400 - DNA, 324 bp, Artificial Sequence
  Description of Artificial Sequence: Synthetic polynucleotide ABT1-95-177
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctatgcgtcgtcctatttggagcccggggtcccatcacgtttcagtggtagtggatccgggacagatttcactctcaccatcagcagtctgcaacccgaagattttgctacgtaccactgtcggcaggggtatcgttggcctgttacgttcggccaagggaccaaggtggaaatcaaacgg

SEQ ID NO: 401 - DNA, 324 bp, Artificial Sequence
  Description of Artificial Sequence: Synthetic polynucleotide ABT1-95-178
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattctgtgtcctatttggagcccggggtcccatcacgtttcagtggtagtggatccgggacagatttcactctcaccatcagcagtctgcaacccgaagattttgctacgtaccactgtcggcaggggtatcgttggcctgttacgttcggccaagggaccaaggtggaaatcaaacgg

SEQ ID NO: 402 - DNA, 324 bp, Artificial Sequence
  Description of Artificial Sequence: Synthetic polynucleotide ABT1-95-179
gacatccagatgacccagtctccatcctccctgtctgcatctgtaggagaccgtgtcaccatcacttgccgggcaagtcagccgattgtgcggaacttaaggtggtatcagcagaaaccagggaaagcccctaagctcctgatctattcttcgtcctatttggagcccggggtcccatcacgtttcagtggtagtggatccgggacagatttcactctcaccatcagcagtctgcaacccgaagattttgctacgtaccactgtcggcaggggtatcgttggcctccgacgttcggccaagggaccaaggtggaaatcaaacgg

SEQ ID NO: 403 - DNA, 324 bp, Artificial Sequence
  Description of Artificial Sequence: Synthetic polynucleotide ABT1-95-181
gacatccagatgacccagtctccatcctccctgtctgcatctgtaggagaccgtgtcaccatcacttgccgggctagtaagccgatcgtgcgtaacatgaggtggtatcagcagaaaccagggaaagcccctaagctcctgatctattcggtgtcctatttggaacccggggtcccatcacgtttcagtggtagtggatccgggacagatttcactctcaccatcagcagtctgcaacccgaagattttgctacgtaccactgtcttcaggggtatcgttggcctcctacattcggccaagggaccaaggtggaaatcaaacgg

SEQ ID NO: 404 - DNA, 324 bp, Artificial Sequence
  Description of Artificial Sequence: Synthetic polynucleotide ABT1-95-182
gacatccagatgacccagtctccatcctccctgtctgcatctgtaggagaccgtgtcaccatcacttgccgggctagtaagccgggtgtgcgtaacttgaggtggtatcagcagaaaccagggaaagcccctaagctcctgatctattcggtgtcctatttggaacccggggtcccatcacgtttcagtggtagtggatccgggacagatttcactctcaccatcagcagtctgcaacccgaagattttgctacgtaccactgtcttcaggggtatcgttggcctcctacattcggccaagggaccaaggtggaaatcaaacgg

SEQ ID NO: 405 - DNA, 324 bp, Artificial Sequence
  Description of Artificial Sequence: Synthetic polynucleotide ABT1-95-183
gacatccagatgacccagtctccatcctccctgtctgcatctgtaggagaccgtgtcaccatcacttgccgggcaagtcggacgatagtgcggaacttacgttggtaccagcagaaaccagggaaagcccctaagctcctgatctattcaaggagctttttggagccgggggtcccatcacgtttcagtggtagtggatccgggacagatttcactctcaccatcagcagtctgcaacccgaagattttgctacgtaccactgtctacaggggtatcgttggcctcctacgttcggccaagggaccaaggtggaaatcaaacgg

SEQ ID NO: 406 - DNA, 324 bp, Artificial Sequence
  Description of Artificial Sequence: Synthetic polynucleotide ABT1-95-184
gacatccagatgacccagtctccatcctccctgtctgcatctgtaggagaccgtgtcaccatcacttgccgggcaagtcggacgcctgtgcggaacttacgttggtatcagcagaaaccagggaaagcccctaagctcctgatctattcaaggagctatttggagccgggggtcccatcacgtttcagtggtagtggatccgggacagatttcactctcaccatcagcagtctgcaacccgaagattttgctacgtaccactgtctacaggggtatcgttggcctcctacgttcggccaagggaccaaggtggaaatcaaacgg

SEQ ID NO: 407 - DNA, 324 bp, Artificial Sequence
  Description of Artificial Sequence: Synthetic polynucleotide ABT1-95-500
gacatccagatgacccagtctccatcctccctgtctgcatctgtaggagaccgtgtcaccatcacttgccgggcaagtcagccgattcatgggaatttacgttggtatcagcagaaaccagggaaagcccctaagctcctgatctataatatctccaatttgcaaagtggggtcccatcgcgtttcagtggcagtggatctggaacagatttcactctcaccatcagcagtctgcaacctgaagattttgctacgtaccactgtcaacaggggtatcgttggcctgttacgttcggccaagggaccaaggtggaaatcaaacgg

SEQ ID NO: 408 - DNA, 324 bp, Artificial Sequence
  Description of Artificial Sequence: Synthetic polynucleotide ABT1-95-501
gacatccagatgacccagtctccatcctccctgtctgcatctgtaggagaccgtgtcaccatcacttgccgggcaagtcagccgattcatgggaatttacgttggtatcagcagaaaccggggaaagcccctaagctcctgatctatagtatttccaatttgcaaagtggggtcccatcacgtttcagtggcagtggatctgggacagatttcactctcaccatcagcagtctgcaacctgaagattttgctacgtactactgtcaacaggggtatcgttggcctgttacgttcggccaagggaccaaggtggaaatcaaacgg

SEQ ID NO: 409 - DNA, 324 bp, Artificial Sequence
  Description of Artificial Sequence: Synthetic polynucleotide ABT1-95-502
gacatccagatgacccagtctccatcctccctgtctgtatctgtaggagaccgtgtcaccatcacctgccgggcaagtcagccgattcatgggaatttacgttggtatcagcagaaaccagggaaagcccctaagctcctgatctataatgtgtccaggttgcaaagtggggtcccatcacgtttcagtggcagtggatctgggacagatttcactctcaccatcagcagtctgcaacctgaagattttgctacgtactactgtcaacaggggtatcgttggcctgttacattcggccaagggaccaaggtggaaatcaaacgg

SEQ ID NO: 410 - DNA, 324 bp, Artificial Sequence
  Description of Artificial Sequence: Synthetic polynucleotide ABT1-95-503
gacatccagatgacccagtctccatcctccctgtctgcatctgtaggagaccgtgtcaccatcacttgccgggcaagtcagccgattcatgggaatttacgttggtatcagcagaaaccagggaaagcccctaagctcctgatctataatgtgtccaggttgcaaagtggggtcccatcacgtttcagtggcagtggatctgggacagatttcactctcaccatcagcagtctgcaacctgaagattttgctacgtactactgtcaacaggggtatcgttggcctgttacgttcggccgagggaccaaggtggaaatcaaacgg

SEQ ID NO: 411 - DNA, 324 bp, Artificial Sequence
  Description of Artificial Sequence: Synthetic polynucleotide ABT1-95-A1
gacatccagatgacccagtctccatcctccctgtctgcatctgtaggagaccgtgtcaccatcacttgccgagccagtcggccgggtgtgaggaacttaaggtggtatcagcagaaaccagggaaagcccctaagctcctgatctatcatgtgagcgatttggagcccggggtcccatcacgtttcagtggtagtggatccgggacagatttcactctcaccatcagcagtctgcaacccgaagattttgctacgtaccactgtcgacaggggtatgtttggcctgttcccttcgaccaagggaccaaggtggaaatcaaacgt

SEQ ID NO: 412 - DNA, 324 bp, Artificial Sequence
  Description of Artificial Sequence: Synthetic polynucleotide ABT1-95-A2
gacatccagatgacccagtctccatcctccctgtctgcatctgtaggagaccgtgtcaccatcacttgccggatacttcagccccctggcaggaacttaaggtggtatcagcagaaaccagggaaagcccctaagctcctgatctattcaaagagctttttggagcccggggtcccatcacgtttcagtggtagtggatccgggacagatttcactctcaccatcagcagtctgcaacccgaagattttgctacgtaccactgtcaacaggggtatcgttggcctgttacgttcggccaagggaccaaggtggaaatcaaacgt

SEQ ID NO: 413 - DNA, 324 bp, Artificial Sequence
  Description of Artificial Sequence: Synthetic polynucleotide ABT1-95-A3
gacatccagatgacccagtctccatcctccctgtctgcatctgtaggagaccgtgtcaccatcacttgccgggctagtaagccgggtgtgcgtaacatgaggtggtatcagcagaaaccagggaaagcccctaagctcctgatctattcggtgtcctatttggaacccggggtcccatcacgtttcagtggtagtggatccgggacagatttcactctcaccatcagcagtctgcaacccgaagattttgctacgtaccactgtcttcaggggtatcgttggcctcctacattcggccaagggaccaaggtggaaatcaaacgg

SEQ ID NO: 414 - DNA, 324 bp, Artificial Sequence
  Description of Artificial Sequence: Synthetic polynucleotide ABT1-95-A5
gacatccagatgacccagtctccatcctccctgtctgcatctgtaggagaccgtgtcaccatcacttgccgggcaagtcggacgcctgtgcggaacttacgttggtatcagcagaaaccagggaaagcccctaagctcctgatctattcaaggagctttttggagccgggggtcccatcacgtttcagtggtagtggatccgggacagatttcactctcaccatcagcagtctgcaacccgaagattttgctacgtaccactgtctacaggggtatcgttggcctcctacgttcggccaagggaccaaggtggaaatcaaacgg

SEQ ID NO: 415 - DNA, 324 bp, Artificial Sequence
  Description of Artificial Sequence: Synthetic polynucleotide ABT1-95-A6
gacatccagatgacccagtctccatcctccctgtctgcatctgtaggagaccgtgtcaccatcacttgccgggctagtaagccgggtgtgcgtaacatgaggtggtatcagcagaaaccagggaaagcccctaagctcctgatctatgctaaatcctatttggagccgggggtcccatcacgtttcagtggtagtggatccgggacagatttcactctcaccatcagcagtctgcaacccgaagattttgctacgtaccactgtaaacaggggtatcgttggccagttcagttcggccaagggaccaaggtggaaatcaaacgg

SEQ ID NO: 416 - DNA, 324 bp, Artificial Sequence
  Description of Artificial Sequence: Synthetic polynucleotide ABT1-119
gacatccagatgacccagtctccatcctccctgtctgcatctgtaggagaccgtgtcaccatcacttgccgggcaagtcaggcgattggtgagtggttaggttggtaccagcagaaaccagggaaagcccctaagctcctgatctataggacgtccgtgttgcaaagtggggtcccatcacgtttcagtggcagtggatctgggacagatttcactctcaccatcagcagtctgcaacctgaagattttgctacgtactactgtcaacagacttctttttttcctcctacgttcggccaagggaccaaggtggaaatcaaacgg

SEQ ID NO: 417 - DNA, 324 bp, Artificial Sequence
  Description of Artificial Sequence: Synthetic polynucleotide ABT1-120
gacatccagatgacccagtctccatcctccctgtctgcatctgtaggagaccgtgtcaccatcacttgccgggcaagtcagaatatttctgtgcttttacgttggtaccagcagaaaccagggaaagcccctaagctcctgatctataatgcgtcccagttgcaaagtggggtcccatcacgtttcagtggcagtggatctgggacagatttcactctcaccatcagcagtctgcaacctgaagattttgctacgtactactgtcaacagtggcggtttagtccccatacgttcggccaagggaccaaggtggaaatcaaacgg

SEQ ID NO: 418 - DNA, 324 bp, Artificial Sequence
  Description of Artificial Sequence: Synthetic polynucleotide ABT1-121
gacatccagatgacccagtctccatcctccctgtctgcatctgtaggagaccgtgtcaccatcacttgccgggcaagtcagccgatttatactgagttatcttggtatcagcagaaaccagggaaagcccctaagctcctgatctatggttcgtccattttgcaaagtggggtcccatcacgtttcagtggcagtggatctgggacagatttcactctcaccatcagcagtctgcaacctgaagattttgctacgtactactgtcaacagtttgcgtatcatcctgtgacgttcggccaagggaccaaggtggaaatcaaacgg

SEQ ID NO: 419 - DNA, 324 bp, Artificial Sequence
  Description of Artificial Sequence: Synthetic polynucleotide ABT1-122
gacatccagatgacccagtctccatcctccctgtctgcatctgtaggagaccgtgtcaccatcacttgccgggcaagtcagccgatttggactgagttaaattggtatcagcagaaaccagggaaagcccctaagctcctgatctatgggtcgtcctcgttgcaaagtggggtcccatcacgtttcagtggcagtggatctgggacagatttcactctcaccatcagcagtctgcaacctgaagattttgctacgtactactgtcaacagtttgcttattttcctgctacgttcggccaagggaccaaggtggaaatcaaacgg

SEQ ID NO: 420 - DNA, 324 bp, Artificial Sequence
  Description of Artificial Sequence: Synthetic polynucleotide ABT1-122-18
gacatccagatgacccagtctccatcctccctgtctgcatctgtaggagaccgtgtcaccatcacttgccgggcaagtcagccgatttggactgagttaaattggtatcagcagaaaccagggaaagcccctaagctcctggtctatgggtcgtcctcgttgcaaagtggggtcccatcacgtttcagtggcagtggatctgggacagatttcactctcaccatcagcagtctgcaacctgaagattttgctacgtactactgtcaacagtttgcttattttcctgctacgttcggccaagggaccaaggtggaaatcaaacgg

SEQ ID NO: 421 - DNA, 324 bp, Artificial Sequence
  Description of Artificial Sequence: Synthetic polynucleotide ABT1-122-21
gacatccagatgacccagtctccatcctccctgtctgcatctgtaggagaccgtgtcaccatcacatgccgggcaagtcagccgatttggactgagttaaattggtatcagcagaaaccagggaaagcccctaagctcctgatctatgggtcgtcctcgttgcaaagtggggtcccaacacgtttcagtggcagtggatctgggacagatttcactctcaccatcagcagtctgcaacctgaagattttgctacgtactactgtcaacagtttgcttattttcctgctacgttcggccaagggaccaaggtggaaatcaaacgg

SEQ ID NO: 422 - DNA, 324 bp, Artificial Sequence
  Description of Artificial Sequence: Synthetic polynucleotide ABT1-122-511
gacatccagatgacccagtctccatcctccctgtctgcatctgtaggagaccgtgtcaccatcacttgccgggcaagtcagccgatttggactgagttaaattggtatcagcagaaaccagggaaagcccctaagctcctgatctatgggtcgtcctcgttgcaaagaggggtcccatcacgtttcagtggcagtggatctgggacagatttcactctcaccatcagcagtctgcaacctgaagattttgctacgtactactgtaaacagtttgcttattttcctgctacgttcggccaagggaccaaggtggaaatcaaacgg

SEQ ID NO: 423 - DNA, 325 bp, Artificial Sequence
  Description of Artificial Sequence: Synthetic polynucleotide ABT1-122-750X
gacatccagatgacccagtctccatcctccctgtctgcatctgtaggagaccgtgtcgccatcacttgctcggcatctcagcatatttggactgagatatcttggtatcagcagaaaccagggaaagcccctaagctcctgatctatggctcggcctcgcggcaaaaaggggtcccatcacgtttcagtggcagtggatctgggacagatttcactctcaccatcagcagtctgcaacctgaagattttgctacgtactactgtaaacagtttgcttattttcctaatacgttcggccaagggaccaaggtggaaatcaaacggg

SEQ ID NO: 424 - DNA, 324 bp, Artificial Sequence
  Description of Artificial Sequence: Synthetic polynucleotide ABT1-123
gacatccagatgacccagtctccatcctccctgtctgcatctgtaggagaccgtgtcaccatcacttgccgggcaagtcagagcatttggacggagttaaagtggtaccagcagaaaccagggaaagcccctaagctcctgatctatggtgcatccctgttgcaaagtggggtcccatcacgtttcagtggcagtggatctgggacagatttcactctcaccatcagcagtctgcaacctgaagattttgctacgtactactgtcaacagtttgcttatcatcctcatacgttcggccaagggaccaaggtggaaatcaaacgg

SEQ ID NO: 425 - DNA, 324 bp, Artificial Sequence
  Description of Artificial Sequence: Synthetic polynucleotide ABT1-124
gacatccagatgacccagtctccatcctccctgtctgcatctgtaggagaccgtgtcaccatcacttgccgggcaagtcagtcgattgagggtaatttacggtggtaccagcagaaaccagggaaagcccctaagctcctgatctataatgtgtcccttttgcaaagtggggtcccatcacgtttcagtggcagtggatctgggacagatttcactctcaccatccgcagtctgcaacctgaagattttgctacgtactactgtcaacaggggtatcgttatcctcctacgttcggccaagggaccaaggtggaaatcaaacgg

SEQ ID NO: 426 - DNA, 324 bp, Artificial Sequence
  Description of Artificial Sequence: Synthetic polynucleotide ABT1-125
gacatccagatgacccagtctccatcctccctgtctgcatctgtaggagaccgtgtcaccatcacttgccgggcaagtcagtcgattcagaagtttttaaattggtaccagcagaaaccagggaaagcccctaagctcctgatctatcggggttccgggttgcaaagtggggtcccaacacgtttcagtggcagtggatctgggacagatttcactctcaccatcagcagtctgcaacctgaggattttgctacgtactactgtcaacaggagtatcggatgcctcttacgttcggccaagggaccaaggtggaaatcaaacgg

SEQ ID NO: 427 - DNA, 324 bp, Artificial Sequence
  Description of Artificial Sequence: Synthetic polynucleotide ABT1-126
gacatccagatgacccagtctccatcctccctgtctgcatctgtaggagaccgtgtcaccatcacttgccgggcaagtcagtctatttataagtatttaagttggtaccagcagaaaccagggaaagcccctatgctcctgatctatagggggtcccatttgcaaagtggggtcccatcacgtttcagtggcagtggatctgggacagatttcactctcaccatcagcagtctgcaacctgaagattttgctacgtactactgtcaacagtatgcgttttcgccttttacgttcggccaagggaccaaggtagaaatcaaacgg

SEQ ID NO: 428 - DNA, 324 bp, Artificial Sequence
  Description of Artificial Sequence: Synthetic polynucleotide ABT1-127
gacatccagatgacccagtctccatcctccctgtctgcatctgtaggagaccgtgtcaccatcacttgccgggcaagtcagagtattaggtattatttaaattggtatcagcagaaaccagggaaagcccctaagctcctgatctattgggattccaagttgcaaagtggggtcccatcacgtttcagtagcagtggatctgggacagatttcactctcaccatcagcagtctgcaacctgaagattttgctacgtactactgtcaacagactgcgtcggctccttttacgttcggccaagggaccaaggtggaaatcaaacgg

SEQ ID NO: 429 - DNA, 324 bp, Artificial Sequence
  Description of Artificial Sequence: Synthetic polynucleotide ABT1-128
gacatccagatgacccagtctccatcctccctgtctgcatctgtaggagaccgtgtcaccatcacttgccgggcaagtcagcctattagggagtttttacattggtatcagcagaaaccagggaaagcccctaagctcctgatctataggtcttcccgtttgcaaagtggggtcccatcacgtttcagtggcagtggatctgggacagatttcactctcaccatcagcagtctgcaacctgaagattttgctacgtactactgtcaacaggagtataggtatcctcttacgttcggccaagggaccaaggtggaaatcaaacgg

SEQ ID NO: 430 - DNA, 324 bp, Artificial Sequence
  Description of Artificial Sequence: Synthetic polynucleotide ABT1-129
gacatccagatgacccagtctccatcctccctgtctgcatctgtaggggacagtgtcgccatcacttgccgggcaagtcagccgattggggcgtttttatcttggtaccagcagaaaccagggaaagcccctaagctcctgatctatgcgatttccaagttgcaaagtggggtcccatcacgtttcagtggcagtggatctgggacagatttcactctcaccatcagcagtctgcaacctgaagattttgctacgtactactgtcaacagcagatgatttcgcctcgtacgttcggccaagggaccaaggtggaaatcaaacgg

SEQ ID NO: 431 - DNA, 324 bp, Artificial Sequence
  Description of Artificial Sequence: Synthetic polynucleotide ABT1-130
gacatccagatgacccagtctccatcctccctgtctgcatctgtaggagaccgtgtcaccatcacttgccgggcaagtcaggagattggtttgtggttatcttggtaccagcagaaatcagggaaagcccctaagctcctgatctatcggcattccagttcgcaaagtggggttccatcacgtttcagtggcagtggatctgggacagatttcactctcaccatcagcagtctgcaacctgaagattttgctacgtactactgtcaacagacttataaggcgccttttacgttcggccaagggaccaaggtggaaatcaaacgg

SEQ ID NO: 432 - DNA, 324 bp, Artificial Sequence
  Description of Artificial Sequence: Synthetic polynucleotide ABT1-131
gacatccagatgacccagtctccatcttccctgtctgcatctgtaggagaccgtgtcaccatcacttgccgggcaagtcagaggattaatgggaatttacgttggtaccagcagaaaccagggaaagcccctaagctcctgatctattctgtttcccagttgcaaagtggggtcccatcacgtttcagtggcagtggatctgggacagatttcactctcaccatcagcagtctgcaacctgaagattttgctacgtactactgtcaacagggttatgattggcctcctacgttcggccaagggaccaaggtggaaaccaaacgg

SEQ ID NO: 433 - DNA, 324 bp, Artificial Sequence
  Description of Artificial Sequence: Synthetic polynucleotide ABT1-132
gacatccagatgacccagtctccatcctccctgtctgcatctgtaggagaccgtgtcaccatcacttgccgggcaagtcagaatattgctacggcgttactttggtaccagcagaaaccagggaaagcccctaggctcctgatctatgattcgtcccagttgcaaagtggggtcccatcacgtttcagtggcagtggatctgggacagatttcactctcaccatcagcagtctgcaacctgaagattttgctacgtactactgtcaacagatgtattgggttccttttacgttcggccaagggaccaaggtggaaatcaaacgg

SEQ ID NO: 434 - DNA, 324 bp, Artificial Sequence
  Description of Artificial Sequence: Synthetic polynucleotide ABT1-133
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagacgatgactgctccttttacgttcggccaagggaccaaggtggaaatcaaacgg

SEQ ID NO: 435 - DNA, 324 bp, Artificial Sequence
  Description of Artificial Sequence: Synthetic polynucleotide
  Chemically synthesized ABT1-134
gacatccagatgacccagtctccatcctccctgtctgcatctgtaggagaccgtgtcaccatcacttgccgggcaagtcagcatatttatgatatgttatcgtggtaccagctgaaaccagggaaagcccctaagctcctgatctatcgtacgtcccttttgcaaagtggggtcccatcacgtttcagtggcagtggatctgggacagatttcactcttaccatcagcagtctgcaacctgaagattttgctacgtactactgtcaacagaatcatcggaggcctcataggttcggccaagggaccaaggtggaaatcaaacgg

SEQ ID NO: 436 - DNA, 324 bp, Artificial Sequence
  Description of Artificial Sequence: Synthetic polynucleotide ABT1-135
gacatccagatgacccagtctccatcctccctgtctgcatctgtaggagaccgtgtcaccatcacttgccgggcaagtcagtatattggtcggaagttaaggtggtatcagcagaaaccagggaaagcccttaagctcctgatctatcggacgtcccgtttgcaaagtggggtcccatcacgtttcagtggcagtggatctgggacagatttcactctcaccatcagcagtctgcaacctgaagattttgctacgtactactgtcaacagacggggcagcatcctcatacgttcggccaagggaccaaggtggaaatcaaacgg

SEQ ID NO: 437 - DNA, 324 bp, Artificial Sequence
  Description of Artificial Sequence: Synthetic polynucleotide ABT1-136
gacatccagatgacccagtctccatcctccctgtctgcatctgtaggagaccgtgtcaccatcacttgccgggcaagtcaggatattgcgaataatttagtgtggtaccagcagaaaccagggaaagcccctaagctcctgatctataggcattcctttttgcaaagtggggtcccatcacgtttcagtggcagtggatctgggacagatttcactctcaccatcagcagtctgcaacctgaagattttgctacgtactactgtcaacagatgcagcaggctccttttacgtccggccaagggaccaaggtggaaatcaaacgg

SEQ ID NO: 438 - DNA, 324 bp, Artificial Sequence
  Description of Artificial Sequence: Synthetic polynucleotide ABT1-141
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 439 - DNA, 324 bp, Artificial Sequence
  Description of Artificial Sequence: Synthetic polynucleotide ABT1-141-1
gacatccagatgacccagtctccatcctccctgtctgcatctgtaggagaccgtgtcaccatcacttgccgggcaagtcagtggattcagaagcagttagcgtggtaccagcagaaaccagggaaagcccctaagctcctgatctatagtggttcctggttgcaaagtggggtcccatcacgtttcagtggcagtggatctgggacagatttcactctcaccatcagcagtctgcaacctgaagattttgctacgtactactgtcaacagcatctgagggtgccttttacgctcggccaagggaccaaggtggaaatcaaacgg

SEQ ID NO: 440 - DNA, 324 bp, Artificial Sequence
  Description of Artificial Sequence: Synthetic polynucleotide ABT1-141-2
gacatccagatgacccagtctccatcctccctgtctgcatctgtaggagaccgtgtcaccatcacttgccgggcaagtcagtggatacagaagcagttagcgtggtaccagcagaaaccagggaaagcccctaagctcctgatctatagtgcgtcctggttgcaaagtggggtcccatcacgtttcagtggcagtggatctgggacagatttcactctcaccatcagcagtctgcaacctgaagattttgctacgtactactgtcaacagcatctgagggtgccttttacgctcggccaagggaccaaggtggaaatcaaacgg

SEQ ID NO: 441 - DNA, 324 bp, Artificial Sequence
  Description of Artificial Sequence: Synthetic polynucleotide ABT1-141-3
gacatccagatgacccagtctccatcctccctgtctgcatctgtaggagaccgtgtcaccatcacttgccgggcaagtcagtggattcagaagcagttagcgtggtaccagcagaaaccagggaaaacccctaagctcctgatctatagtcagtcccatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 442 - DNA, 324 bp, Artificial Sequence
  Description of Artificial Sequence: Synthetic polynucleotide ABT1-141-6
gacatccagatgacccagtctccatcctccctgtctgcatccgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtctacagcatctgagggtgccttttacgttcggccaagggaccaaggtggaaatcaaacgg

SEQ ID NO: 443 - DNA, 324 bp, Artificial Sequence
  Description of Artificial Sequence: Synthetic polynucleotide ABT1-141-7
gacatccagatgacccagtctccatcctccctgtctgcatctgtaggagaccgtatcaccatcacttgccgggcaagtcagtggattcagaagcagttagcgtggtaccagctgaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 444 - DNA, 324 bp, Artificial Sequence
  Description of Artificial Sequence: Synthetic polynucleotide ABT1-141-8
gacatccagatgacccagtctccatcctccctgtctgcatctgtaggagaccgtgtcaccatcacttgccgggcaagtcagtggattcagaagcagttagcgtggtaccagctgaaaccagggaaagcccctaagctcctgatctatagttcttcctggttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 445 - DNA, 324 bp, Artificial Sequence
  Description of Artificial Sequence: Synthetic polynucleotide ABT1-141-9
gacatccaggtgacccagtctccatcctccctgtctgcatctgtaggagaccgtgtcaccatcacttgccgggcaagtcagtggattcagaagcagttagcgtggtaccagcagaaaccagggaaagcccctaagctcctgatctattcttcttcctggttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 446 - DNA, 324 bp, Artificial Sequence
  Description of Artificial Sequence: Synthetic polynucleotide ABT1-141-10
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagtcgcttcgggtgccctttacgttcggccaagggaccaaggtggaaatcaaacgg

SEQ ID NO: 447 - DNA, 324 bp, Artificial Sequence
  Description of Artificial Sequence: Synthetic polynucleotide ABT1-141-11
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagtggatgagtcctcctcgtacgttcggccaagggaccaaggtggaaatcaaacgg

SEQ ID NO: 448 - DNA, 324 bp, Artificial Sequence
  Description of Artificial Sequence: Synthetic polynucleotide ABT1-141-12
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgatcggccaagggaccaaggtggaaatcaaacgg

SEQ ID NO: 449 - DNA, 324 bp, Artificial Sequence
  Description of Artificial Sequence: Synthetic polynucleotide ABT1-141-13
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatttgaggactcctccgacgttcggccaagggaccaaggtggaaatcaaacgg

SEQ ID NO: 450 - DNA, 324 bp, Artificial Sequence
  Description of Artificial Sequence: Synthetic polynucleotide ABT1-141-14
gatattcagatgacccagagcccgagcagcctgagcgcgagcgtgggcgatcgtgtgaccattacctgccgtgcgagccagtggattcagaaacagctggcgtggtatcagcagaaaccgggcaaagcgccgcgtctgctgatttatagcagcagctatctgcagagcggcgtgccgagccgttttagcggcagcggcagcggcaccgattttaccctgaccattagcagcctgcagccggaagattttgcgacctattattgccagcagaacctgagcgtgccgtttacctttggccagggcaccaaagtggaaattaaacgt

SEQ ID NO: 451 - DNA, 324 bp, Artificial Sequence
  Description of Artificial Sequence: Synthetic polynucleotide ABT1-141-15
gacatccagatgacccagtctccaccctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 452 - DNA, 324 bp, Artificial Sequence
  Description of Artificial Sequence: Synthetic polynucleotide ABT1-141-16
gacatccagatgacccagtctccatcctccctgtctgcatctgtaggagaccgtgtcgccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacatcatctgagggtgccttttacgttcggccaagggaccaaggtggaaatcaaacgg

SEQ ID NO: 453 - DNA, 324 bp, Artificial Sequence
  Description of Artificial Sequence: Synthetic polynucleotide ABT1-141-17
gacatccagatgacccagtctccatcctccctgtctgcatctgtaggagaccgtgtcaccatcacttgccgggcaagtcagtggattcagaagcagttagcgtggtatcagctgaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 454 - DNA, 324 bp, Artificial Sequence
  Description of Artificial Sequence: Synthetic polynucleotide ABT1-141-18
gacatccagatgacccagtctccatcctccctgtctgcatctgtaggagaccgtgtcaccatcacttgccgggcaagtcagtggattcagaagcagttagcgtggtatcagcagaaaccagggaaagtccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 455 - DNA, 324 bp, Artificial Sequence
  Description of Artificial Sequence: Synthetic polynucleotide ABT1-141-19
gacatccagatgacccagtctccatcctccctgtctgcatctgtaggagaccgtgtcaccatcacttgccgggcaagtcagtggattcagaagcagttagcgtggtaccagcagaaaccagggaaagcccctaagctcctgatctattcgagttcctggttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 456 - DNA, 324 bp, Artificial Sequence
  Description of Artificial Sequence: Synthetic polynucleotide ABT1-141-20
gacatccagatgacccagtctccatcctccctgtctgcatctgtaggagaccgtgtcaccatcacttgccgggcaagtcagtggattcagaagcagttagcgtggtaccagcagaaaccagggaaagcccctaagctcctgatctattcggcttcctggttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 457 - DNA, 324 bp, Artificial Sequence
  Description of Artificial Sequence: Synthetic polynucleotide ABT1-141-21
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcagatgtcgtctcctcgtacgttcggccaagggaccaaggtggaaatcaaacgg

SEQ ID NO: 458 - DNA, 324 bp, Artificial Sequence
  Description of Artificial Sequence: Synthetic polynucleotide ABT1-141-22
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcagatggctcctcctcgtacgttcggccaagggaccaaggtggaaatcaaacgg

SEQ ID NO: 459 - DNA, 324 bp, Artificial Sequence
  Description of Artificial Sequence: Synthetic polynucleotide ABT1-141-23
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcagatgcagcctcctcgtacgttcggccaagggaccaaggtggaaatcaaacgg

SEQ ID NO: 460 - DNA, 324 bp, Artificial Sequence
  Description of Artificial Sequence: Synthetic polynucleotide ABT1-141-24
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagactttgctacgtactactgtcaacagcatctgagggtgcctccgacgttcggccaagggaccaaggtggaaatcaaacgg

SEQ ID NO: 461 - DNA, 324 bp, Artificial Sequence
  Description of Artificial Sequence: Synthetic polynucleotide ABT1-141-25
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 462 - DNA, 324 bp, Artificial Sequence
  Description of Artificial Sequence: Synthetic polynucleotide ABT1-141-27
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagggtcttaggcagcctatgactttcggccaagggaccaaggtggaaatcaaacgg

SEQ ID NO: 463 - DNA, 324 bp, Artificial Sequence
  Description of Artificial Sequence: Synthetic polynucleotide ABT1-141-28
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgctcggccaagggaccaaggtggaaatcaaacgg

SEQ ID NO: 464 - DNA, 324 bp, Artificial Sequence
  Description of Artificial Sequence: Synthetic polynucleotide ABT1-141-29
gacatccaggtgacccagtctccatcctccctgtctgcatctgtaggagaccgtgtcaccatcacttgccgggcaagtcagtggattcagaagcagttagcgtggtatcagctgaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgccttttacgttcggccaagggaccaaggtggaaatcaaacgg

SEQ ID NO: 465 - DNA, 324 bp, Artificial Sequence
  Description of Artificial Sequence: Synthetic polynucleotide ABT1-141-30
gacatccaggtgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 466 - DNA, 324 bp, Artificial Sequence
  Description of Artificial Sequence: Synthetic polynucleotide ABT1-141-31
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 467 - DNA, 324 bp, Artificial Sequence
  Description of Artificial Sequence: Synthetic polynucleotide ABT1-141-32
gacatccagatgacccagtctccatcctccctgtctgcatctgtaggagaccgtatcaccatcacttgccgggcaagtcagtggattcagaagcagttagcgtggtaccagctgaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgcctatgacgttcggccaagggaccaaggtggaaatcaaacgg

SEQ ID NO: 468 - DNA, 324 bp, Artificial Sequence
  Description of Artificial Sequence: Synthetic polynucleotide ABT1-141-33
gacatccagatgacccagtctccatcctccctgtctgcatctgtaggagaccgtgtcaccatcacttgccgggcaagtcagtggattcagaagcagttagcgtggtaccagctgaaaccagggaaagcccctaagctcctgatctatagttcttcctggttgcaaagtggggtcccatcacgtttcagtggcagtggatctgggacagatttcactctcaccatcagcagtctgcaacctgaagattttgctacgtactactgtcaacagcatctgagggtgcctatgacgttcggccaagggaccaaggtggaaatcaaacgg

SEQ ID NO: 469 - DNA, 324 bp, Artificial Sequence
  Description of Artificial Sequence: Synthetic polynucleotide ABT1-141-34
gacatccagacgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatctgagggtgcctatgacgttcggccaagggaccaaggtggaaatcaaacgg

SEQ ID NO: 470 - DNA, 324 bp, Artificial Sequence
  Description of Artificial Sequence: Synthetic polynucleotide ABT1-141-35
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattctgcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 471 - DNA, 324 bp, Artificial Sequence
  Description of Artificial Sequence: Synthetic polynucleotide ABT1-141-42
gacctccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 472 - DNA, 324 bp, Artificial Sequence
  Description of Artificial Sequence: Synthetic polynucleotide ABT1-141-43
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccaccacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 473 - DNA, 324 bp, Artificial Sequence
  Description of Artificial Sequence: Synthetic polynucleotide ABT1-141-44
gacatccagattacccagtctccatcatccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgattcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 474 - DNA, 324 bp, Artificial Sequence
  Description of Artificial Sequence: Synthetic polynucleotide ABT1-141-45
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagcggatctgggacagatttcactctcaccatcagtagtctgcaacttgaagattttgctacgtactactgtcaacagcatcttcgtgttcctatgacgctcggccaagggaccaaggtggaaatcaaacgg

SEQ ID NO: 475 - DNA, 324 bp, Artificial Sequence
  Description of Artificial Sequence: Synthetic polynucleotide ABT1-141-46
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcccatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggtaatcaaacgg

SEQ ID NO: 476 - DNA, 324 bp, Artificial Sequence
  Description of Artificial Sequence: Synthetic polynucleotide ABT1-141-47
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatctattcttcgtcccatttgcaaagtggggtcccatcacgtttcagtggcagtggatctgggacagatttcactctcaccatcagcagtctgcaacctcaagattttgctacgtactactgtcaacagcatcttcgtgttcctatgacgttcggccaagggaccaaggtggaaatcaaacgg

SEQ ID NO: 477 - DNA, 324 bp, Artificial Sequence
  Description of Artificial Sequence: Synthetic polynucleotide ABT1-141-48
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatcttttcttcgtcccatttgcaaagtggggtcccatcacgtttcagtggcagtggatctgggacagatttcactctcaccatcagcagtctgcaacctgaagattttgcttcgtactactgtcaacagcatcttcgtgttcctatgacgttcggccaagggaccaaggtggaaatcaaacgg

SEQ ID NO: 478 - DNA, 324 bp, Artificial Sequence
  Description of Artificial Sequence: Synthetic polynucleotide ABT1-141-49
gacatccagatgacccagtctccatcctccctgtctgcatctgtaggagaccgtgtcaccatcacttgccgggcaagtcagtggattcagaagcagttagcgtggtatcagctgaaaccagggaaagcccctaagctcctgatctattcttcgtcccattcgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 479 - DNA, 324 bp, Artificial Sequence
  Description of Artificial Sequence: Synthetic polynucleotide ABT1-141-50
gacatccagatgacccagtctccatcctccctgtctgcatctgtaggagaccgtgtcaccatcacttgccgggcaagtcagtggattcagaagcagttagcgtggtatcagcagaaaccagggaaaacccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaatgtggaaatcaaacgg

SEQ ID NO: 480 - DNA, 324 bp, Artificial Sequence
  Description of Artificial Sequence: Synthetic polynucleotide ABT1-141-51
gacatccagatgacccagtctccatcctccctgtctgcatctgtaggagaccgtgtcaccatcacttgccgggcaagtcagtggattcagaagcagttagcgtggtatcagcagaaaccagggaaagtccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggtaatcaaacgg

SEQ ID NO: 481 - DNA, 324 bp, Artificial Sequence
  Description of Artificial Sequence: Synthetic polynucleotide ABT1-141-52
gacatccagatgacccagtctccatcctccctgtctgcatctgtaggagaccgtgtcaccatcacttgccgggcaaatcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgctcggccaagggaccaaggtggaaatcaaacgg

SEQ ID NO: 482 - DNA, 324 bp, Artificial Sequence
  Description of Artificial Sequence: Synthetic polynucleotide ABT1-141-53
gacatccagatgacccagtctccatcctccctgtctgcatctgtaggagaccgtgtcaccatcacttgccgggcaagtcagtggattcagaagcagttagcgtggtatcagctgaaaccagggaaaacccctaagctcctgatcttttcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 483 - DNA, 324 bp, Artificial Sequence
  Description of Artificial Sequence: Synthetic polynucleotide ABT1-141-54
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcccatttgcaaagtggggtcccatcacgtttcagtggcagtggatctgggacagatttcactctcaccatcagcagtctgcaacctgaagattttgctacgtactactgtcaacagcatcttcgtgttcctatgacgtttggccaagggaccaaggtggaaatcaaacgg

SEQ ID NO: 484 - DNA, 324 bp, Artificial Sequence
  Description of Artificial Sequence: Synthetic polynucleotide ABT1-141-70
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcccatttgcaaagtggggtcccatcacgtttcagtggcagtggatatgggacagatttcactctcaccatcagcagtctgcaaccagaagattttgctacgtactactgtcaacagcatcttcgtgttcctatgacgttcggccaagggaccaaggtggaaatcaaacgg

SEQ ID NO: 485 - DNA, 324 bp, Artificial Sequence
  Description of Artificial Sequence: Synthetic polynucleotide ABT1-141-75
gacatccagatgacccagtctccatcctccctgtctgcatctgtaggagaccgtgtcaccatcacttgccgggcaaatcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 486 - DNA, 324 bp, Artificial Sequence
  Description of Artificial Sequence: Synthetic polynucleotide ABT1-141-76
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatctattcttcgtcccatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 487 - DNA, 324 bp, Artificial Sequence
  Description of Artificial Sequence: Synthetic polynucleotide ABT1-141-77
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatcttctcttcgtcccatttgcaaagtggggtcccatcacgtttcagtggcagtggatctgggacagatttcactctcaccatcagcagtctgcaacctcaagattttgctacgtactactgtcaacagcatcttcgtgttcctatgacgttcggccaagggaccaaggtggaaatcaaacgg

SEQ ID NO: 488 - DNA, 324 bp, Artificial Sequence
  Description of Artificial Sequence: Synthetic polynucleotide ABT1-141-78
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatctattcttcgtcccatttgcaaagtggggtcccatcacgtttcagtggcagtggatacgggacagatttcactctcaccatcagcagtctgcaacctcaagattttgctacgtactactgtcaacagcatcttcgtgttcctatgacgttcggccaagggaccaaggtggaaatcaaacgg

SEQ ID NO: 489 - DNA, 324 bp, Artificial Sequence
  Description of Artificial Sequence: Synthetic polynucleotide ABT1-141-79
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatcttctcttcgtcccatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 490 - DNA, 324 bp, Artificial Sequence
  Description of Artificial Sequence: Synthetic polynucleotide ABT1-141-80
gacatccagatgacccagtctccatcctccctgtctgcatctgtaggagaccgtgtcaccatcacttgccgggcaaatcagtggattcagaagcagttagcgtggtatcagcagaaaccggggaaagcccctaagctcctgatctattcttcgtcccatttgcaaagtggggtcccatcacgtttcagtggcagtggatacgggacagatttcactctcaccattagcagtctgcaacctgaagattttgctacgtactactgtcaacagcatcttcgtgttcctatgacgttcggccaagggaccaaggtggaaatcaaacgg

SEQ ID NO: 491 - DNA, 324 bp, Artificial Sequence
  Description of Artificial Sequence: Synthetic polynucleotide ABT1-141-500
gacatccagatgacccagtatccatcctccctgtctgcatctgtaggagaccgtgtcaccatcacttgccgggcaagtcagtggattcagaagcagctagcgtggtatcagcagaaaccagggaaagcccctaagctcctgatctattcttcgtcctatttgcaaagtggggtcccatcacgtttcagtggcagtggatctgggacagatttcactctcaccatcagcagtctgcggcctgaagattttgctacgtactactgtcaacagcatctgagggtgccttttacgttcggccaagggaccaaggtggaaatcaaacgg

SEQ ID NO: 492 - DNA, 324 bp, Artificial Sequence
  Description of Artificial Sequence: Synthetic polynucleotide ABT1-141-501
gacatcttgatgacccagtctccatcctccctgtctgcatctgtaggagaccgtgtcaccatcacttgccgggcaagtcagtggattcagaagcagttagcgtggtatcagcagaaaccagggaaagcccctaagctcctgatctactccgcctccacgttgcaaagtggggtcccatcacgtttcagtggcagtggatctgggacagatttcactctcaccatcagcagtctgcaacctgaagattttgctacgtactactgtcaacagtggctgtctattcctcatacgttcggccaagggaccaaggtgggaatcaaacgg

SEQ ID NO: 493 - DNA, 324 bp, Artificial Sequence
  Description of Artificial Sequence: Synthetic polynucleotide ABT1-141-502
gacatccaggtgacccagtctccatcctccctgtctgcatctgtaggagaccgtgtcaccatcacttgccgggcaagtcagtggattcagaagcagttagcgtggtaccagcagaaaccagggaaagcccccaggctcctgatctatgctgcgtccgctttgcgaagtggggtcccatcacgtttcagtggcagtggatctgggacagatttcactctcaccatcagcagtctgcaacctgaagattttgccacgtactactgtcaacagactttgaggagcccttttacgttcggccaagggaccaaggtggaaatcaaacgg

SEQ ID NO: 494 - DNA, 324 bp, Artificial Sequence
  Description of Artificial Sequence: Synthetic polynucleotide ABT1-141-503
gacatccagatgacccagtccccatcctccctgtctgcatctgtaggaggccgtgtcaccatcacttgccgggcaagtcagtggattcagaagcagttagcgtggtatcagcagaaaccagggaaagcccccaagctcctggtctatgcggcttcctggttgcaaagtggggtcccatcacgtttcagtggcagtggatctgggacagatttcactctcaccatcagcagtctgcaacctgaagattttgctacgtactactgtcaacagagtctgagggcgccttttacgttcggccaagggaccaaggtggaaatcaaacgg

SEQ ID NO: 495 - DNA, 324 bp, Artificial Sequence
  Description of Artificial Sequence: Synthetic polynucleotide ABT1-141-504
gacatccagatgacccagtctccatcctccctgtctgcatctgtaggagaccgtgtcaccatcacttgccgggcaagtcagtggattcagaagcagttagcgtggtatcagcagaaaccagggggagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagaatctgtcggttccttttacgttcggccaagggaccaaggtggaaatcaaacgg

SEQ ID NO: 496 - DNA, 324 bp, Artificial Sequence
  Description of Artificial Sequence: Synthetic polynucleotide ABT1-141-505
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagaatctgtcggttccttttacgttcggccaagggaccaaggtggaaatcaaacgg

SEQ ID NO: 497 - DNA, 324 bp, Artificial Sequence
  Description of Artificial Sequence: Synthetic polynucleotide ABT1-141-506
gacatccagatgacccagtccccatcctccctgtctgcatctgtaggagaccgtgtcaccatcacttgccgggcaagtcagtggattcagaagcagttagcgtggtatcagcagaagccagggagagcccctaggctcctgatctattcttcgtcctatttgcaaagcggggtcccatcacgtttcagtggcagtggatctgggacagatttcactctcaccatcagcagtctgcaacctgaagattttgctacgtactactgtcaacagaatctgtcggttccttttacgttcggccaagggaccaaggtggaaatcaaacgg

SEQ ID NO: 498 - DNA, 324 bp, Artificial Sequence
  Description of Artificial Sequence: Synthetic polynucleotide ABT1-141-507
gatattcagatgacccagagcccgagcagcctgagcaccagcgtgggcgatcgtgtgaccattacctgccgtgcgagcctgtggattcagaaacagctggcgtggtatcagcagaaaccgggcaaagcgccgaaactgctgatttatgcgggcagctttctgcagagcggcgtgccgagccgttttagcggcagcggcagcggcaccgattttgcgctgaccattagcagcctgcagccggaagattttgcgacctattattgccagcagaccctgttttatccgtttacctttggccagggcaccaaagtggaaattaaacgt

SEQ ID NO: 499 - DNA, 324 bp, Artificial Sequence
  Description of Artificial Sequence: Synthetic polynucleotide ABT1-141-508
gatattcagatgacccagagcccgagcagcctgagcgcgagcgtgggcgatcgtgtgaccattacctgccgtgcgagccagtggattcagaaacagctggcgtggtatcagcagaaaccgggccgtgcgccgaaactgctgatttatagcagcagctatctgcagagcggcgtgccgagccgttttagcggcagcggcagcggcaccgattttaccctgaccattagcagcctgcagccggaagattttgcggcgtattattgccagcagcatctgcgtgtgccgaacacctttagccagggcaccaaagtggaagtgaaacgt

SEQ ID NO: 500 - DNA, 324 bp, Artificial Sequence
  Description of Artificial Sequence: Synthetic polynucleotide ABT1-141-509
gatattcagatgacccagagcccgagcagcctgagcgcgagcgtgggcgatcgtgtgaccattacctgccgtgcgaaccagtggattcagaaacagctggcgtggtatcagcagaaaccgggcaaagcgctgaaactgctggtgtatagcgcgagctatctgcagagcggcgtgccgagccgttttagcggcagcggcagcggcaccgattttaccctgaccattagcagcctgcagccggaagattttgcgacctattattgccagcagcatctgcgtgtgccgtttacctttggccagggcaccaaagtggaaattaaacgt

SEQ ID NO: 501 - DNA, 324 bp, Artificial Sequence
  Description of Artificial Sequence: Synthetic polynucleotide ABT1-141-510
gatattcagatgacccagagcccgagcagcctgagcgcgagcgtgggcgatcgtgtgaccattacctgccgtgcgagccagtggattcagaaacagctggcgtggtatcagcagaaaccgggcaaagcgccgaaactgctggtgtatgcggcgagctggctgcagagcggcgtgccgagccgttttagcggcagcggcagcggcaccgattttaccctgaccattagcagcctgcagccggaagattttgcgacctattattgccagcagagcctgcgtgcgccgtttacctttggccagggcaccaaagtggaaattaaacgt

SEQ ID NO: 502 - DNA, 324 bp, Artificial Sequence
  Description of Artificial Sequence: Synthetic polynucleotide ABT1-141-511
gatattcagatgacccagagcccgagcagcctgagcgcgagcgtgggcgatcgtgtgaccattacctgccgtgcgagccagtggattcagaaacagctggcgtggtatcagcagaaaccgggcaaaaccccgaaactgctgatttatagcagcagctatctgcagagcggcattccgagccgttttagcggcagcggcagcggcaccgattttaccctgaccattagcagcctgcagccggaagattttgcgacctattattgccagcagcatctgcgtgtgccgtttacctttggccagggcaccaaagtggaaattaaacgt

SEQ ID NO: 503 - DNA, 324 bp, Artificial Sequence
  Description of Artificial Sequence: Synthetic polynucleotide ABT1-141-512
gatattcagatgacccagagcccgagcagcctgagcgcgagcgtgggcgatcgtgtgaccattacctgccgtgcgagccagtggattcagaaacagctggcgtggtatcagcagaaaccgggcaaagtgccgaaactgctgatttatagcagcagctatctgcagagcggcgtgccgagccgttttaacggcagcggcagcggcaccgattttaccctgaccattagcagcctgcagccggaagattttgcgacctattattgccagcagaccctgaccgtgccgtttacctttggccagggcaccaaagtggaaattaaacgt

SEQ ID NO: 504 - DNA, 324 bp, Artificial Sequence
  Description of Artificial Sequence: Synthetic polynucleotide ABT1-141-513
gatattcaggtgacccagagcccgagcagcctgagcgcgagcgtgggcgatcgtgtgaccattacctgccgtgcgagccagtggattcagaaacagctggcgtggtatcagcagaaaccgggcaaagcgccgcgtctgctgatttatgcggcgagcgcgctgcagagcggcgtgccgagccgttttagcggcggcggcagcggcaccgattttaccctgaccattagcggcctgcagccggaagattttgcgacctattattgccagcagaccctgcgtagcccgtttacctttggccagggcaccaaagtggaaattaaacgt

SEQ ID NO: 505 - DNA, 324 bp, Artificial Sequence; identical to SEQ ID NO: 450
  Description of Artificial Sequence: Synthetic polynucleotide ABT1-141-514

SEQ ID NO: 506 - DNA, 324 bp, Artificial Sequence
  Description of Artificial Sequence: Synthetic polynucleotide ABT1-141-516
gacatccagatgacccagtctccatcctccctgtctgcatctgtaggagaccgtgtcaccatcaattgccgggcaaatcagtggattcagaagcagttagcgtggtaccagcagaaaccagggaaggcccttaagctcctggtctatagtgcgtcctatctgcaaagtggggtcccatcacgtttcagtggcagtggatctgggtcagatttcactctcaccatcagcagtctgcaacctgaagattttgctacgtactactgtcaacagcatctgagggtgccttttacgttcggccaagggaccaaggtggaaatcaaacgg

SEQ ID NO: 507 - DNA, 324 bp, Artificial Sequence
  Description of Artificial Sequence: Synthetic polynucleotide ABT1-141-519
gacatccagatgacccagtctccatcctccctgtctgcatctgtaggagaccgtgtcaccttcacttgccgggcaagtcagtggattcagaagcagttagcgtggtaccagcagaaaccagggaaagtccctaagctcctgatctattcttcgtcctatttgcaaagtggggtcccatcacgtttcagtggcagtggatctgggacagatttcactctcaccatcagcagtctgcaacctgaagattttgctacgtacttctgtcaacagactttgactgtgccttttacgttcggccaagggaccaaggtggaaatcaaacgg

SEQ ID NO: 508 - DNA, 324 bp, Artificial Sequence
  Description of Artificial Sequence: Synthetic polynucleotide ABT1-141-520
gacatccagatgacccagtctccatcctccctgtctgcatctgtaggagaccgtgtcaccatcaattgccgggcaaatcagtggattcagaagcagttagcgtggtaccagcagaaaccagggaaggcccttaagctcctggtctatagtgcgtcctatctgcaaagtggggtcccatcaaggttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 509 - DNA, 324 bp, Artificial Sequence
  Description of Artificial Sequence: Synthetic polynucleotide ABT1-141-521
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcgtcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 510 - DNA, 324 bp, Artificial Sequence
  Description of Artificial Sequence: Synthetic polynucleotide ABT1-141-522
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcgtcgtcctggtggcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 511 - DNA, 324 bp, Artificial Sequence; identical to SEQ ID NO: 509
  Description of Artificial Sequence: Synthetic polynucleotide ABT1-141-523

SEQ ID NO: 512 - DNA, 324 bp, Artificial Sequence
  Description of Artificial Sequence: Synthetic polynucleotide ABT1-141-524
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcctggttgcaaaggggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 513 - DNA, 324 bp, Artificial Sequence
  Description of Artificial Sequence: Synthetic polynucleotide ABT1-141-525
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcctggttgcaaagtggggccccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 514 - DNA, 324 bp, Artificial Sequence
  Description of Artificial Sequence: Synthetic polynucleotide ABT1-141-526
gacatccagatgacccagtctccatcctccctgtctgcatctgtaggagaccgtgtcgccatcacttgccgggcaagtcagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 515 - DNA, 324 bp, Artificial Sequence
  Description of Artificial Sequence: Synthetic polynucleotide ABT1-141-527
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgtcctatttgcaaagtggggtcccatcacgtctcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 516 - DNA, 324 bp, Artificial Sequence
  Description of Artificial Sequence: Synthetic polynucleotide ABT1-141-528
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgatgcataagcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 517 - DNA, 324 bp, Artificial Sequence
  Description of Artificial Sequence: Synthetic polynucleotide ABT1-141-529
gacatccagatgacccagtctccatcctccctgtctgcatctgtaggagaccgtgtcaccatcacttgccgggcaaaccagtggattcagaagcagttagcgtggtatcagcagaaaccagggaaagcccctaagctcctgatctatagctcgtccacgttgcaaagtgggaccccatcacgtttcagtggcagtggatctgggacagatttcactctcaccatcagcagtctgcaacctgaagattttgctacgtactactgtcaacagcatcttcgtgttcctatgacgctcggccaagggaccaaggtggaaatcaaacgg

SEQ ID NO: 518 - DNA, 324 bp, Artificial Sequence
  Description of Artificial Sequence: Synthetic polynucleotide ABT1-141-530
aacatccagatgacccagtctccatcctccctgtctgcatctgtaggagaccgtgtcaccatcacttgccgggcatcggagtggattcagaagcagttagcgtggtatcagcagaaaccagggaaagcccctaagctcctgatctatagctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 519 - DNA, 324 bp, Artificial Sequence
  Description of Artificial Sequence: Synthetic polynucleotide ABT1-141-531
gacatccagatgacccagtctccatcctccctgtctgcatctgtaggagaccgtgtcaccatcacttgccgggcagaccagtggattcagaagcagttagcgtggtatcagcagaaaccagggaaagcccctaagctcctgatctatagctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 520 - DNA, 324 bp, Artificial Sequence
  Description of Artificial Sequence: Synthetic polynucleotide ABT1-141-532
gacatccaggtgacccagtctccatcctccctgtctgcatctgtaggagaccgtgtcaccatcacttgccgggcagaccagtggattcagaagcagttagcgtggtatcagcagaaaccagggaaagcccctaagctcctgatctatagctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 521 - DNA, 324 bp, Artificial Sequence
  Description of Artificial Sequence: Synthetic polynucleotide ABT1-141-533
gacatccagatgacccagtctccatcctccctgtctgcatctgtaggagaccgtgtcaccatcacttgccggacgaaccagtggattcagaagcagttagcgtggtatcagcagaaaccagggaaagcccctaagctcctgatctattcttcgtcccataaccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 522 - DNA, 324 bp, Artificial Sequence
  Description of Artificial Sequence: Synthetic polynucleotide ABT1-141-534
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgaaccatccgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaagtcaaacgg

SEQ ID NO: 523 - DNA, 324 bp, Artificial Sequence
  Description of Artificial Sequence: Synthetic polynucleotide ABT1-141-535
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcggcgcatgcgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 524 - DNA, 324 bp, Artificial Sequence
  Description of Artificial Sequence: Synthetic polynucleotide ABT1-141-536
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcggcccatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 525 - DNA, 324 bp, Artificial Sequence
  Description of Artificial Sequence: Synthetic polynucleotide ABT1-141-537
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgatgcatacccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 526 - DNA, 324 bp, Artificial Sequence
  Description of Artificial Sequence: Synthetic polynucleotide ABT1-141-538
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgaaccattcccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 527 - DNA, 324 bp, Artificial Sequence
  Description of Artificial Sequence: Synthetic polynucleotide ABT1-141-539
gacatccagatgacccagtctccatcctccctgtctgcatctgtaggagaccgtgtcaccatcacttgccgggcgaacgagtggattcagaagcagttagcgtggtatcagcagaaaccagggaaagcccctaagctcctgatctattcttcgatgcatccccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 528 - DNA, 324 bp, Artificial Sequence
  Description of Artificial Sequence: Synthetic polynucleotide ABT1-141-541
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgatgcatccgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 529 - DNA, 324 bp, Artificial Sequence
  Description of Artificial Sequence: Synthetic polynucleotide ABT1-141-542
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgatgcattcccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 530 - DNA, 324 bp, Artificial Sequence
  Description of Artificial Sequence: Synthetic polynucleotide ABT1-141-543
gacatccagatgacccagtctccatcctccctgtctgcatctgtaggagaccgtgtcaccatcacttgccggtcgaacgagtggattcagaagcagttagcgtggtatcagcagaaaccagggaaagcccctaagctcctgatctattcttcgacccatcggcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 531 - DNA, 324 bp, Artificial Sequence
  Description of Artificial Sequence: Synthetic polynucleotide ABT1-141-544
gacatccagatgacccagtctccatcctccctttctgcatctgtaggagaccgtgtcaccatcacttgccgggcaagtcagtggattcagaagcagttagcgtggtatcagctgaaaccagggaaagcccctaagctcctgatctattcttcgtcatatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 532 - DNA, 324 bp, Artificial Sequence
  Description of Artificial Sequence: Synthetic polynucleotide ABT1-141-545
gacatccagatgacccagtctccatcctccctgtctgcatctgtaggagaccgtgtcaccatcacttgccgggcaaaccagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 533 - DNA, 324 bp, Artificial Sequence
  Description of Artificial Sequence: Synthetic polynucleotide ABT1-141-546
gacatccagatgacccagtctccatcctccctgtctgcatctgtaggagaccgtgtcaccatcacttgccgggcatcggagtggattcagaagcagttagcgtggtatcagcagaaaccagggaaagcccctaagctcctgatctattcgtcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 534 - DNA, 324 bp, Artificial Sequence
  Description of Artificial Sequence: Synthetic polynucleotide ABT1-141-547
gacatccagatgacccagtctccatcctccctgtctgcatctgtaggagaccgtgtcaccatcacttgccgggcaaactcgtggattcagaagcagttagcgtggtatcagcagaaaccagggaaagcccctaagctcctgatctattcttcgtcctatttgcaaagtggggtcccatcacgtctcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 535 - DNA, 324 bp, Artificial Sequence
  Description of Artificial Sequence: Synthetic polynucleotide ABT1-141-548
gacatccagatgacccagtctccatcctccctgtctgcatctgtaggagaccgtgtcaccatcacttgccgggcagaccagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 536 - DNA, 324 bp, Artificial Sequence; identical to SEQ ID NO: 532
  Description of Artificial Sequence: Synthetic polynucleotide ABT1-141-549

SEQ ID NO: 537 - DNA, 324 bp, Artificial Sequence
  Description of Artificial Sequence: Synthetic polynucleotide ABT1-141-550
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcctggttgcaaagtgggatcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 538 - DNA, 324 bp, Artificial Sequence; identical to SEQ ID NO: 466
  Description of Artificial Sequence: Synthetic polynucleotide ABT1-141-551

SEQ ID NO: 539 - DNA, 324 bp, Artificial Sequence
  Description of Artificial Sequence: Synthetic polynucleotide ABT1-141-552
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctatagctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 540 - DNA, 324 bp, Artificial Sequence
  Description of Artificial Sequence: Synthetic polynucleotide ABT1-141-553
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcgtcgtcctggttgcaaagtggggccccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 541 - DNA, 324 bp, Artificial Sequence; identical to SEQ ID NO: 539
  Description of Artificial Sequence: Synthetic polynucleotide ABT1-141-554

SEQ ID NO: 542 - DNA, 324 bp, Artificial Sequence
  Description of Artificial Sequence: Synthetic polynucleotide ABT1-141-555
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcccactcgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 543 - DNA, 324 bp, Artificial Sequence
  Description of Artificial Sequence: Synthetic polynucleotide ABT1-141-556
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 544 - DNA, 324 bp, Artificial Sequence
  Description of Artificial Sequence: Synthetic polynucleotide ABT1-141-557
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctatagctcgtcctggatgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 545 - DNA, 324 bp, Artificial Sequence
  Description of Artificial Sequence: Synthetic polynucleotide ABT1-141-558
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctatatgtcgtccgagttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 546 - DNA, 324 bp, Artificial Sequence
  Description of Artificial Sequence: Synthetic polynucleotide ABT1-141-559
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcctcgtcctggtcgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 547 - DNA, 324 bp, Artificial Sequence
  Description of Artificial Sequence: Synthetic polynucleotide ABT1-141-561
gacatccagatgacccagtctccatcctccctgtctgcatctgtaggagaccgtgtcaccatcacttgccaggcacaccagtggattcagaagcagttagcgtggtatcagcagaaaccagggaaagcccctaagctcctgatctattcctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 548 - DNA, 324 bp, Artificial Sequence
  Description of Artificial Sequence: Synthetic polynucleotide ABT1-141-562
gacatccagatgacccagtctccatcctccctgtctgcatctgtaggagaccgtgtcaccatcacttgccgggcaaaccagtggattcagaagcagttagcgtggtatcagcagaaaccagggaaagcccctaagctcctgatctatagctcgtcctggttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 549 - DNA, 324 bp, Artificial Sequence
  Description of Artificial Sequence: Synthetic polynucleotide ABT1-141-563
gacatccagatgacccagtctccatcctccctgtctgcatctgtaggagaccgtgtcaccatcacttgccgggcagacagctggattcagaagcagttagcgtggtatcagcagaaaccagggaaagcccctaagctcctgatctattcttcgtcctatttgcaaagtggggtcccatcacgtttcagtggcagaggatctgggacagatttcactctcaccatcagcagtctgcaacctgaagattttgcttcgtactactgtcaacagcatcttcgtgttcctatgacgttcggccaagggaccaaggtggaaatcaaacgg

SEQ ID NO: 550 - DNA, 324 bp, Artificial Sequence
  Description of Artificial Sequence: Synthetic polynucleotide ABT1-141-564
gacatccagatgacccagtctccatcctccctgtctgcatctgtaggagaccgtgtcaccatcacttgccggagcaacgagtggattcagaagcagttagcgtggtatcagcagaaaccagggaaagcccctaagctcctgatctattcttcgtcctatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 551 - DNA, 324 bp, Artificial Sequence
  Description of Artificial Sequence: Synthetic polynucleotide ABT1-141-565
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgatgcatctccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 552 - DNA, 324 bp, Artificial Sequence
  Description of Artificial Sequence: Synthetic polynucleotide ABT1-141-567
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctactcttcgaaccatccccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 553 - DNA, 324 bp, Artificial Sequence
  Description of Artificial Sequence: Synthetic polynucleotide ABT1-141-568
gacatccagatgacccagtctccatcctccctgtctgcatctgtaggagaccgtgtcaccatcacttgccgggcaagtcagtggattcagaagcagttagcgtggtatcagcagaaaccagggaaagcccctaagctcctgatctattcttcgggccatccccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 554 - DNA, 324 bp, Artificial Sequence
  Description of Artificial Sequence: Synthetic polynucleotide ABT1-141-569
gacatccagatgacccagtctccatcctccctgtctgcatctgtaggagaccgtgtcaccatcacttgccgggccaaccagtggattcagaagcagttagcgtggtatcagcagaaaccagggaaagcccctaagctcctgatctattcttcgtcccatccccaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 555 - DNA, 324 bp, Artificial Sequence
  Description of Artificial Sequence: Synthetic polynucleotide ABT1-141-572
gacatccagatgacccagtctccatcctccctgtctgcatctgtaggagaccgtgtcaccatcacttgccggagcaacgagtggattcagaagcagttagcgtggtatcagcagaaaccagggaaagcccctaagctcctgatctattcttcgtcccatttgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 556 - DNA, 324 bp, Artificial Sequence
  Description of Artificial Sequence: Synthetic polynucleotide ABT1-141-573
gacatccagatgacccagtctccatcctccctgtctgcatctgtaggagaccgtgtcaccatcacttgccggaccaacgagtggattcagaagcagttagcgtggtatcagcagaaaccagggaaagcccctaagctcctgatctattcttcggcccataggcaaagtggggtcccatcacgtttcagtggcagtggatctgggacaggtttcactctcaccatcagcagtctgcaacctgaagattttgctacgtactactgtcaacagcatcttcgtgttcctatgacgttcggccaagggaccaaggtggaaatcaaacgg

SEQ ID NO: 557 - DNA, 324 bp, Artificial Sequence
  Description of Artificial Sequence: Synthetic polynucleotide ABT1-141-574
gacatccagatgacccagtctccatcctccctgtctgcatctgtaggagaccgtgtcaccatcacttgccggatcaacgagtggattcagaagcagttagcgtggtatcagcagaaaccagggaaagcccctaagctcctgatctattcttcgacacatccgcaaagtggggtcccatcacgtttcagtggcagtggatctgggacagatttcactctcaccatcagcagtctgcaacctgaagattttgctacgtactactgtcaacagcatcttcgtgttcctatgacgttcggccaagggaccaaggtggaaatcaaacgg

SEQ ID NO: 558 - DNA, 324 bp, Artificial Sequence
  Description of Artificial Sequence: Synthetic polynucleotide ABT1-142
gacatccagatgacccagtctccatcctccctgtctgcatctgtaggagaccgtgtcaccatcacttgccgggcaagtcagtcgattaatgatgtgttagcttggtaccagcagaaaccagggaaagcccctaggctcctgatctattcggcttcctatttgcaaagtggggtcccatcacgtttcagtggcagtggatctgggacagatttcactctcaccatcagcagtctgcaacctgaagattttgctacgtactactgtcaacagtatattagtcttccttttacgttcggccaagggaccaaggtggaaatcaaacgg

SEQ ID NO: 559 - DNA, 324 bp, Artificial Sequence
  Description of Artificial Sequence: Synthetic polynucleotide ABT1-143
gacatccagatgacccagtctccatcctccctgtctgcatctgtaggagaccgtgtcaccatcacttgccgggcaagtcagaggattgatcgtcatttatcttggtatcagcagaaaccagggaaagcccctaagctcctgatctataagacttccaagttgcaaagtggggtcccatcacgtttcagtggcagtggatctgggacagatttcacactcaccatcagcagtctgcaacctgaagattttgctacgtactactgtcagcagcttcatgctaagccttttacgttcggtcaagggaccaaggtggaaatcaaacgg

SEQ ID NO: 560 - DNA, 324 bp, Artificial Sequence
  Description of Artificial Sequence: Synthetic polynucleotide ABT1-144
gacatccagatgacccagtctccatcctccctgtctgcatctgtaggagaccgtgtcactatcacttgccgggcaagtcagcggattaagaagtatttagcttggtaccagcagaaaccagggaaagcccctaggctcctgatctatcgttcttcccagttgcaaagtggggtcccatcacgtttcagtggcagtggatctgggacagatttcactctcaccatcagcagtctgcaacctgaagattttgctacgtactactgtcaacagtcgtttaagaggcctgttacgttcggccaagggaccaaggtggaaatcaaacgg

SEQ ID NO: 561 - DNA, 324 bp, Artificial Sequence
  Description of Artificial Sequence: Synthetic polynucleotide ABT1-145
gacatccagatgacccagtctccatcctccctgtctgcatctgtaggagaccgtgtcaccatcacttgccgggcaagtcaggatattgatgatggtttagcgtggtatcagcagaaacccgggaaagcccctaagctcctgatctatcgtacgtcccggttgcaaagtggggtcccatcacgtttcagtggcagtggatctgggacagatttcactctcaccatcagcagtctgcaacctgaagattttgctacgtactactgtcaaccgacttggctgcctccttgtacgttcggccaagggaccaaggtggaaatcaaacgg

SEQ ID NO: 562 - DNA, 324 bp, Artificial Sequence
  Description of Artificial Sequence: Synthetic polynucleotide ABT1-146
gacatccagatgacccagtctccatcctccctgtctgcatctgtaggagaccgtgtcaccatcacttgccgggcaagtcagaatattaagacgtttttacattggtatcagcagaaaccagggaaagcccctaagctcctgatctatcgtgtttcccatttgcaaagtggggttccatcacgtttcagtggcagtggatctgggacagatttcactctcaccatcagcagtctgcaacctgaagattttgctacgtactactgtcaacaggagtatcgtattcctcttacgttcggccaagggaccaaggtggaaatcaaacgg

SEQ ID NO: 563 - DNA, 324 bp, Artificial Sequence
  Description of Artificial Sequence: Synthetic polynucleotide ABT1-148
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggggctctgtccggtttgcaaagtggggtcccatcacgtttcagtggcagtggatctgggacagatttcactctcaccatcagcagtctgcaacctgaagattttgctacgtactactgtatgcagtggtatcgtcatccttctacgttcggccaagggaccaaggtggaaatcaaacgg

SEQ ID NO: 564 - DNA, 360 bp, Artificial Sequence
  Description of Artificial Sequence: Synthetic polynucleotide ABT1-149
gacatccagatgacccagtctccatcctctctgtctgcatctgtaggagaccgtgtcaccatcacttgccgggcaagtcagagcattagcagctatttaaattggtaccagcagaaaccagggaaagcccctaagctcctgatcggtgggctgtccggtttgcaaagtggggtcccatcacgtttcagtggcagtggatctgggacagatttcactctcaccatcagcagtctgcaacctgaagattttgctacgtactactgtatgcagtggtggcggtggccttcgacgttcggccaagggaccaaggtggaaatcaagcgggcggccgcagaacaaaaactcatctcagaagaggat

SEQ ID NO: 565 - DNA, 360 bp, Artificial Sequence
  Description of Artificial Sequence: Synthetic polynucleotide ABT1-150
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcgggggtgtttccggtttgcaaagtggggtcccatcacgtttcagtggcagtggatctgggacagatttcactctcaccatcagcagtctgcaacctgaagattttgctacgtactactgtatgcagtggtggcggtggccttcgacgttcggccaagggaccaaggtggaaatcaaacgggcggccgcagaacaaaaactcatctcagaagaggat

SEQ ID NO: 566 - DNA, 360 bp, Artificial Sequence
  Description of Artificial Sequence: Synthetic polynucleotide ABT1-151
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcgggggtcgttccgggttgcaaagtggggtcccatcacgtttcagtggcagtggatctgggacagatttcactctcaccatcagcagtctgcaacctgaagattttgctacgtactactgtgggcagtggtatcggcatcctgcgacgttcggccaagggaccaaggtggaaatcaaacgggcggccgcagaacaaaaactcatctcagaagaggat

SEQ ID NO: 567 - DNA, 360 bp, Artificial Sequence
  Description of Artificial Sequence: Synthetic polynucleotide ABT1-152
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggggggaggtccggtttgcaaagtggggtcccatcacgtttcagtggcagtggatctgggacagatttcactctcaccatcggcagtctgcaacctgaagattttgctacgtactactgcatgcagtggtatagggcgcctagtacgttcggccaagggaccaaggtggaaatcaaacgggcggccgcagaacaaaaactcatctcagaagaggat

SEQ ID NO: 568 - DNA, 360 bp, Artificial Sequence
  Description of Artificial Sequence: Synthetic polynucleotide ABT1-153
gacatccagatgacccagtctccatcctccctgtctgcatctgtaggagaccgtgtcaccatcacttgccgggcaagtagtcctattgtggctaatttacgttggtaccagcagaaaccagggaaagcccctaagctcctgatctatgctgcatccagtttgcaaagtggggtcccatcacgtttcagtggcagtggatctgggacagatttcactctcaccatcagcagtctgcaacctgaagattttgctacgtactactgtactcaggggtatgtgtggcctccgacgttcggccaagggaccaaggtggaaatcaaacgggcggccgcagaacaaaaactcatctcagaagaggat

SEQ ID NO: 569 - DNA, 324 bp, Artificial Sequence
  Description of Artificial Sequence: Synthetic polynucleotide ABT1-154
gacatccagatgacccagtctccatcctccctgtctgcatctgtaggagaccgtgtcaccatcacttgccgggcaagtactgagattgtgcgtaatttacggtggtaccagcagaaaccagggaaagcccctaagctcctgatctcgggtgtttccgggttgcaaagtggggtcccatcacgtttcagtggcagtggatctgggacagatttcactctcaccatcagcagtctgcaacctgaagattttgctacgtactactgtgttcagggttattcttggcctgttacgttcggccaagggaccaaggtggaaatcaaacgg

SEQ ID NO: 570 - DNA, 324 bp, Artificial Sequence
  Description of Artificial Sequence: Synthetic polynucleotide ABT1-155
gacatccagatgacccagtctccatcctccctgtctgcatctgtaggagaccgtgtcaccatcacttgccgggcaagtagtcctattgtggctaatttacgttggtaccagcagaaaccagggaaagcccctaagctcctgatctatgctgcatccagtttgcaaagtggggtcccatcacgtttcagtggcagtggatctgggacagatttcactctcaccatcagcagtctgcaacctgaagattttgctacgtactactgtactcaggggtatgtgtggcctccgacgttcggccaagggaccaaggtggaaatcaaacgg

SEQ ID NO: 571 - DNA, 324 bp, Artificial Sequence
  Description of Artificial Sequence: Synthetic polynucleotide ABT1-156
gacatccagatgacccagtctccatcctccctgtctgcatctgtaggagaccgtgtcaccatcacttgccgggcaagttcgactattttggataagttagagtggtaccagcagaaaccagggaaagcccctaagctcctgatctctggtgcgtcctggttgcaaagtggggtcccatcacgtttcagtggcagtggatctgggacagatttcactctcaccatcagcagtctgcaacctgaagattttgctacgtactactgtcggcaggcgttgtgggatcctccgacgttcggccaagggaccaaggtggaaatcaaacgg

SEQ ID NO: 572 - DNA, 324 bp, Artificial Sequence
  Description of Artificial Sequence: Synthetic polynucleotide ABT1-157
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcgggggtgtgtccgggttgcaaagtggggtcccatcacgtttcagtggcagtggatctgggacagatttcactctcaccatcagcagtctgcaacctgaagattttgctacgtactactgtatgcagtggtctcggccgcctcggacgttcggccaagggaccaaggtggaaatcaaacgg

SEQ ID NO: 573 - DNA, 321 bp, Artificial Sequence
  Description of Artificial Sequence: Synthetic polynucleotide ABT1-158
gacatccagatgacccagtctccatcctccctgtctgcatctgtaggagaccgtgtcaccatcacttgccgggcaagtaggtctattgggcgtgggttaaattggtaccagcagaaaccagggaaagcccctaagctcctgatcggggggtggtccgggttgcaaagtggggtcccatcacgtttcagtggcagtggatctgggacagatttcactctcaccatcagcagtctgcaacctgaagattttgctacgtactactgtgctcaggcgtcgccgcttccgacgttcggccaagggaccaaggtggaaatcaaacgg

SEQ ID NO: 574 - DNA, 324 bp, Artificial Sequence
  Description of Artificial Sequence: Synthetic polynucleotide ABT1-159
gacatccagatgacccagtctccatcctccctgtctgcatctgtaggagaccgtgtcaccatcacttgccgggcaagtagtcctattggtatggatttattttggtaccagcagaaaccagggaaagcccctaggctcctgatcgatggtgtgtccggtttgcaaagtggggtcccatcacgtttcagtggcagtggatctgggacagatttcactctcaccatcagcagtctgcaacctgaagattttgctacgtactactgttctcagcattggcctgcgcctctgacgttcggccaagggaccaaggtggaaatcaaacgg

SEQ ID NO: 575 - DNA, 324 bp, Artificial Sequence
  Description of Artificial Sequence: Synthetic polynucleotide ABT1-160
gacatccagatgacccagtctccatcctccctgtctgcatctgtaggagaccgtgtcaccatcacttgtcgggcaagtactgagattgtgcgtaatttacggtggtaccagcagaaaccagggaaagcccctaatctcctgatctgggggggttccactttgcaaagtggggtcccatcacgtttcagtggcagtggatctgggacagatttcactctcaccatcagcagtctgcaacctgaagattttgctacgtactactgtgttcagggttattctttgcctgttacgttcggccaagggaccaaggtggaaatcaaacgg

SEQ ID NO: 576 - DNA, 324 bp, Artificial Sequence
  Description of Artificial Sequence: Synthetic polynucleotide ABT1-161
gacatccagatgacccagtctccatcctccctgtctgcatctgtaggagaccgtgtcaccatcacttgccgggcaagtcatgctattactggtagtttacgttggtaccagcagaaaccagggaaagcccctaagctcctgatcagtggtgggtccgtgttgcaaagtggggtcccatcacgtttcagtggcagtggatctgggacagatttcactctcaccatcagcagtctgcaacctgaagattttgctacgtactactgtgctcagtggttgggggggcctatgacgttcggccaagggaccaaggtggaaatcaaacgg

SEQ ID NO: 577 - DNA, 324 bp, Artificial Sequence
  Description of Artificial Sequence: Synthetic polynucleotide ABT1-162
gacatccagatgacccagtctccatcctccctgtctgcatctgtaggaggccgcgtcaccatcacttgccgggcaagtcattatattaggaatcggttacattggtaccagcagaaaccagggaaagcccctaagctcctgatcgcgcgtgggtccgctttgcaaagtggggtcccatcacgtttcagtggcagtggatctgggacagatttcactctcaccatcagcagtctgcaacctgaagattttgctacgtactactgtgtgcaggatggttatctgcctcctacgttcggccaagggaccaaggtggaaatcaaacgg

SEQ ID NO: 578 - DNA, 324 bp, Artificial Sequence
  Description of Artificial Sequence: Synthetic polynucleotide ABT1-163
gacatccagatgacccagtctccatcctccctgtctgcatctgtaggagaccgtgtcaccatcacttgccgggcaagtgggaatattgtgcataatttacgttggtaccagcagaaaccagggaaagcccctaagctcctgatctatgctgcatccaggttgcaaagtggggtcccatcacgtttcagtggcagtggatctgggacagatttcactctcaccatcagcagtctgcaacctgaagattttgctacgtactactgtgcgcaggggtatgagtggcctcttacgttcggccaagggaccaaggtggaaatcaaacag

SEQ ID NO: 579 - DNA, 324 bp, Artificial Sequence
  Description of Artificial Sequence: Synthetic polynucleotide ABT1-164
gacatccagatgacccagtctccatcctccctgtctgcatctgtaggagaccgtgtcaccatcacttgccgggcaagtcgtccgattgctggtaatttacggtggtaccagcagaaaccagggaaagcccctaagctcctgatctggggggcgtcctcgttgcaaagtggggtcccatcacgtttcagtggcagtggatctgggacagatttcactctcaccatcagcagtctgcaacctgaagattttgctacgtactactgtgtgcaggggtggcagtggcctattacgttcggccaagggaccaaggtggaaatcaaacgg

SEQ ID NO: 580 - DNA, 324 bp, Artificial Sequence
  Description of Artificial Sequence: Synthetic polynucleotide ABT1-165
gacatccagatgacccagtctccatcctccctgtctgcatctgtaggagaccgtgtcaccatcacttgccgggcaagttcttcgattagggcgggtttagcttggtaccagcagaaaccagggaaagcccctaagctcctgatcgggcctgagtccgggttgcaaagtggggtcccatcacgtttcagtggcagtggatctgggacagatttcactctcaccatcagcagtctgcaacctgaagattttgctacgtactactgtgggcaggggattgatggtcctgctacgttcggccaagggaccaaggtggaaatcaaacgg

SEQ ID NO: 581 - DNA, 324 bp, Artificial Sequence
  Description of Artificial Sequence: Synthetic polynucleotide ABT1-166
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggtggtctgtccggtttgcaaagtggggtcccatcacgtttcagtggcagtggatctgggacagatttcactctcaccatcagcagtctgcaacctgaagattttgctacgtactactgtggtcagtgggcgcgtgctcctatgacgttcggccaagggaccaaggtggaaatcaaacgg

SEQ ID NO: 582 - DNA, 324 bp, Artificial Sequence
  Description of Artificial Sequence: Synthetic polynucleotide ABT1-167
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggtgggctgtccggtttgcaaagtggggtcccatcacgtttcagtggcagtggatctgggacagatttcactctcaccatcagcagtctgcaacctgaagattttgctacgtactactgtatgcagtggtggcggtatcctcctacgttcggccaagggaccaaggtggaaatcaaacgg

SEQ ID NO: 583 - DNA, 324 bp, Artificial Sequence
  Description of Artificial Sequence: Synthetic polynucleotide ABT1-168
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggggggctgtccggtttgcaaagtggggtcccatcacgtttcagtggcagtggatctgggacagatttcactctcaccatcagcagtctgcaacctgaagattttgctacgtactactgtctgcagtggttttctgagcctgctacgttcggccaagggaccaaggtggaaatcaaacgg

SEQ ID NO: 584 - DNA, 324 bp, Artificial Sequence
  Description of Artificial Sequence: Synthetic polynucleotide ABT1-169
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggtgggttgtccgggttgcaaagtggggtcccatcacgtttcagtggcagtggatctgggacagatttcactctcaccatcagcagtctgcaacctgaagattttgctacgtactactgtatgcagtggtggcggtggccttcgacgttcggccaagggaccaaggtggaaatcaaacgg

SEQ ID NO: 585 - DNA, 324 bp, Artificial Sequence
  Description of Artificial Sequence: Synthetic polynucleotide ABT1-170
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcgggggtcggtccgggttgcaaagtggggtcccatcacgtttcagtggcagtggatctgggacagatttcactctcaccatcagcagtctgcaacctgaagattttgctacgtactactgtaagcagtggtataggtatccttctacgttcggccaagggaccaaggtggaaatcaaacgg

SEQ ID NO: 586 - DNA, 324 bp, Artificial Sequence
  Description of Artificial Sequence: Synthetic polynucleotide ABT1-171
gacatccagatgacccagtctccatcctccctgtctgcatctgtaggagaccgtgtcaccatcacttgccgggcaagtcagagcattagcagctatttaaattggtaccagcagaaaccagggaaagcccctaagctcctgatcggggggcggtccggtttgcaaagtggggtcccatcacgtttcagtggcagtggatctgggacagatttcactctcaccatcagcagtctgcaacctgaagattttgctacgtactactgtatgcagtggtttcgtccgcctaggacgttcggccaagggaccaaggtggaaatcaaacgg

SEQ ID NO: 587 - DNA, 324 bp, Artificial Sequence
  Description of Artificial Sequence: Synthetic polynucleotide ABT1-172
gacatccagatgacccagtctccatcctccctgtctgcatctgtaggagaccgtgtcaccatcacttgccgggcaagtcagcgtattcgtaatggtttagagtggtaccagcagaaaccagggaaagcccctaagctcctgatctgggggtcgtcccgtttgcaaagtggggtcccatcacgtttcagtggcagtggatctgggacagatttcactctcaccatcagcagtctgcaacctgaagattttgctacgtactactgtgcgcagacggtttggggtcctgcgacgttcggccaagggaccaaggtggaaatcaaacgg

SEQ ID NO: 588 - DNA, 324 bp, Artificial Sequence
  Description of Artificial Sequence: Synthetic polynucleotide ABT1-221
gacatccagatgacccagtctccatcctccctgtctgcatctgtaggggaccgtgttaccatcacttgccgggcaagtcaggatatttggccttatttaatgtggtatcagcagaaaccagggaaagcccctaagctcctaatctattattcttccatgttgcaaagtggggtcccatcacgtttcagtggcagtggatctgggacagatttcactctcaccatcagcagtctgcaacctgaagattttgctacgtactactgtcaacagtttaggaggtggccttatacgttcggccaagggaccaaggtggaaatcaaacgg

SEQ ID NO: 589 - DNA, 360 bp, Artificial Sequence
  Description of Artificial Sequence: Synthetic polynucleotide ABT2 VH dAbs:ABT2-10
gaggtgcagctgttggagtctgggggaggcttggtacagcctggggggtccctgcgtctctcctgtacagcctccggattcacctttaataggtataatatggcgtgggcccgccaggctccagggaagggtctagagtgggtctcagagattgatcttaagggtagtcagacatactacgcagactccgtgaagggccggttcaccatctcccgcgacaattccaagaacacgctgtatctgcaaatgaacagcctgcgtgccgaggacaccgcggtatattactgtgcgaaagtgagtattagtgcgtatcatatgtttgactactggggtcagggaaccctggtcaccgtctcgagc

SEQ ID NO: 590 - DNA, 360 bp, Artificial Sequence
  Description of Artificial Sequence: Synthetic polynucleotide ABT2-11
gaggtgcagctgttggagtctgggggaggcttggtacagcctggggggtccctgcgtctctcctgtgcagcctccggattcacctttgataattattctatgacgtgggtccgccaggctccagggaagggtctggagtgggtctcagctattagtggtagtggtggtagcacatactacgcagactccgtgaagggccggttcaccatctcccgcgacaattccaagaacacgctgtatctgcaaatgaacagcctgcgtgccgaggataccgcggtatattactgtgcgaaatgtattgatcgtttgccttgtctgtttgactactggggtcagggaaccctggtcaccgtctcgagc

SEQ ID NO: 591 - DNA, 351 bp, Artificial Sequence
  Description of Artificial Sequence: Synthetic polynucleotide ABT2-12
gaggtgcagctgttggagtctgggggaggcttggtacagcctggggggtccctgcgtctctcctgtgcagcctccggattcacctttacgggttatgatatggcttgggtccgccaggctccagggaagggtctagagtgggtctcagtgatttatgcttatggtgagtctacatactacgcagactccgtgaagggccggttcaccatctcccgcgacaattccaagaacacgctgtatctgcaaatgaacagcctgcgtgccgaggacaccgcggtatattactgtgcgaaaatgacttctgcttcttttgactactggggtcagggaaccctggtcaccgtctcgagc

SEQ ID NO: 592 - DNA, 348 bp, Artificial Sequence
  Description of Artificial Sequence: Synthetic polynucleotide ABT2-13
gaggtgcagctgttggagtctgggggaggcttggtacagcctggggggtccctgcgtctctcctgtgcagcctccggattcacctttcgggattatgttatgtattgggcccgccaggctccagggaagggtctagagtgggtctcaaggattgatcctatgggtagttcgacatactacgcagactccgtgaagggccggttcaccatctcccgcgacaattccaagaacacgctgtatctgcaaatgaacagcctgcgtgccgaggacaccgcggtatattactgtgcgaaacctgagggtaattttgactactggggtcagggaaccctggtcaccgtctcgagc

SEQ ID NO: 593 - DNA, 351 bp, Artificial Sequence
  Description of Artificial Sequence: Synthetic polynucleotide ABT2-14
gaggtgcagctgttggagtctgggggaggcctggtacagcctggggggtccctgcgtctctcctgtgcagcctccggattcacctttgcggattatgatatgtcttgggtccgccaggctccagggaagggtctagagtgggtctcaactatttatggttttggttttgcgacatactacgcagactccgtgaagggccggttcaccatctcccgcgacaattccaagaacacgctgtatctgcaaatgaacagcctgcgtgccgaggacaccgcggtatattactgtgcgaaaacgttggctggggggtttgactactggggtcagggaaccctggtcaccgtctcgagc

SEQ ID NO: 594 - DNA, 351 bp, Artificial Sequence
  Description of Artificial Sequence: Synthetic polynucleotide ABT2-15
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaatggctaatgctaagtttgactactggggtcagggaaccctggtcaccgtctcgagc

SEQ ID NO: 595 - DNA, 354 bp, Artificial Sequence
  Description of Artificial Sequence: Synthetic polynucleotide ABT2-16
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaaataaggggcatgggcagtttgactactggggtcagggaaccctggtcaccgtctcgagc

SEQ ID NO: 596 - DNA, 351 bp, Artificial Sequence
  Description of Artificial Sequence: Synthetic polynucleotide ABT2-17
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggataccgcggtatattactgtgcgaaaatgaaggggagtacttttgactactggggtcagggaaccctggtcaccgtctcgagc

SEQ ID NO: 597 - DNA, 351 bp, Artificial Sequence
  Description of Artificial Sequence: Synthetic polynucleotide ABT2-19
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaacgtctccggagtcttttgactactggggtcagggaaccctggtcaccgtctcgagc

SEQ ID NO: 598 - DNA, 351 bp, Artificial Sequence
  Description of Artificial Sequence: Synthetic polynucleotide ABT2-20
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggactccgcggtatattactgtgcgaaacctagtattgatggttttgactactggggtcagggaaccctggtcaccgtctcgagc

SEQ ID NO: 599 - DNA, 351 bp, Artificial Sequence
  Description of Artificial Sequence: Synthetic polynucleotide ABT2-21
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaagttagtagtgatacttttgactactggggtcagggaaccctggtcaccgtctcgagc

SEQ ID NO: 600 - DNA, 360 bp, Artificial Sequence
  Description of Artificial Sequence: Synthetic polynucleotide ABT2-22
gaggtgcagctgttggagtctgggggaggcttggtacagcctggggggtccctgcgtctctcctgtgcagcctccggattcacccttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaagggcctttgtctacgcatgatagttttgactactggggtcagggaaccctggtcaccgtctcgagc

SEQ ID NO: 601 - DNA, 360 bp, Artificial Sequence
  Description of Artificial Sequence: Synthetic polynucleotide ABT2-23
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtgtattactgtgcgaaagggaattcgagtttggatccgaattttgactactggggtcagggaaccctggtcaccgtctcgagc

SEQ ID NO: 602 - DNA, 360 bp, Artificial Sequence
  Description of Artificial Sequence: Synthetic polynucleotide ABT2-24
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacgattccaagaacacgctgtatctgcaaatgaacagcctgcgtgccgaggataccgcggtatattactgtgcgaaaactcagcctaggtctctggataattttgactactggggtcagggaaccctggtcaccgtctcgagc

SEQ ID NO: 603 - DNA, 357 bp, Artificial Sequence
  Description of Artificial Sequence: Synthetic polynucleotide ABT2-25
gaggtgcagctgttggagtctgggggaggcttggtacagcctggggggtccctgcgtctctcctgtgcagcctccggattcaccttttctaagtataagatgtcgtgggtccgccaggctccagggaagggtctagagtgggtctcaagtattagtagttctggttctactacatactacgcagactccgtgaagggccggttcaccatctcccgcgacaattccaagaacacgctgtatctgcaaatggacagcctgcgtgccgaggacaccgcggtatattactgtgcgaaacctctgttgttggatgtggagtttgactactggggtcagggaaccctggtcaccgtctcgagc

SEQ ID NO: 604 - DNA, 357 bp, Artificial Sequence
  Description of Artificial Sequence: Synthetic polynucleotide ABT2-26
gaggtgcagctgttggagtctgggggaggcttggtacagcctggggggtccctgcgtctctcctgtgcagcctccggattcaccttttctaattataagatgtcgtgggtccgccaggctccagggaagggtctagagtgggtctcaagtattaatacttctggttctactacatactacgcagactccgtgaagggccggttcaccatctcccgcgacaattccaagaacacgctgtatctgcaaatggacagcctgcgtgccgaggacaccgcggtatattactgtgcgaaacctctgttgttggatgtggagtttgactactggggtcagggaaccctggtcaccgtctcgagc

SEQ ID NO: 605 - DNA, 360 bp, Artificial Sequence
  Description of Artificial Sequence: Synthetic polynucleotide ABT2-27
gaggtgcagctgttggagtctgggggaggcttggtacagcctggggggtccctgcgtctctcctgtgcagcctccggattcacctttgcgcattattcgatgtggtgggtccgccaggctccagggaagggtctagagtgggtctcacgtattgggtctccgggtaatgatacatactacgcagactccgtgaagggccggttcaccatctcccgcgacaattccaagaacacgctgtatctgcaaatgaacagcctgcgtgccgaggacaccgcggtatattactgtgcgaaatttgggtttaggtctgcggagtcttttgactactggggtcagggaaccctggtcaccgtctcgagc

SEQ ID NO: 606 - DNA, 360 bp, Artificial Sequence
  Description of Artificial Sequence: Synthetic polynucleotide ABT2-28
gaggtgcagctgttggagtctgggggaggcttggtacagcctggggggtccctgcgtctctcctgtgcagcctccggattcacctttacgggttatgatatggcttgggtccgccaggctccagggaagggtctagagtgggtctcagtgatttatgcttatggtgagtctacatactacgcagactccgtgaagggccggttcaccatctcccgcgacaattccaagaacacgctgtatctgcaaatgaacagcctgcgtgccgaggataccgcggtatattactgtgcgaaacctgtgcaggggtcgttgttggggtttgactactggggtcagggaaccctggtcaccgtctcgagc

SEQ ID NO: 607 - DNA, 363 bp, Artificial Sequence
  Description of Artificial Sequence: Synthetic polynucleotide ABT2-29
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaagcgacgtttgggaatctggaggagtcgtttgactactggggtcagggaaccctggtcaccgtctcgagc

SEQ ID NO: 608 - DNA, 366 bp, Artificial Sequence
  Description of Artificial Sequence: Synthetic polynucleotide ABT2-30
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaatattcggctgggccttttgggcagacgctgtttgactactggggtcagggaaccctggtcaccgtctcgagc

SEQ ID NO: 609 - DNA, 366 bp, Artificial Sequence
  Description of Artificial Sequence: Synthetic polynucleotide ABT2-31
gaggtgcagctgttggagtctgggggaggcttggtacagcctggggggtccctgcgtctctcctgtgcagcctccggattcacctttacgggttatgatatggcttgggtccgccaggctccagggaagggtctagagtgggtctcagtgatttatgcttatggtgagtctacatactacgcagactccgtgaagggccggttcaccatctcccgcgacaattccaagaacacgctgtatctgcaaatgaacagcctgcgtgccgaggacaccgcggtatattactgtgcgaaaaagagtaaggggccttctggtcttcgtacgtttgactactggggtcagggaaccctggtcaccgtctcgagc

SEQ ID NO: 610 - DNA, 363 bp, Artificial Sequence
  Description of Artificial Sequence: Synthetic polynucleotide ABT2-32
gaggtgcagctgttggagtctgggggaggcttggtacagcctggggggtccctgcgtctctcctgtgcagcctccggattcacctttacgggttatgatatggcttgggtccgccaggctccagggaagggtctagagtgggtctcagtgatttatgcttatggtgagtctacatactacgcagactccgtgaagggccggttcaccatctcccgcgacaattccaagaacacgctgtatctgcaaatgaacagcctgcgtgccgaggacaccgcggtatattactgtgcgaaaactacgccgaagtctaatctgcgtgattttgactactggggtcagggaaccctggtcaccgtctcgagc

SEQ ID NO: 611 - DNA, 366 bp, Artificial Sequence
  Description of Artificial Sequence: Synthetic polynucleotide ABT2-33
gaggtgcagctgttggagtctgggggaggcttggtacagcctggggggtccctgcgtctctcctgtgcagcctccggattcacctttgaggattatgctatggcttgggcccgccaggctccagggaagggtctagagtgggtctcatctattttggcggatggtcattcgacacactacgcagactccgtgaagggccggttcaccatctcccgcgacaattccaagaacacgctgtatctgcaaatgaacagcctgcgtgccgaggacaccgcggtatattactgtgcgaaaccttatgcggcggtttttaatcgtgtgtattttgactactggggtcagggaaccctggtcaccgtctcgagc

SEQ ID NO: 612 - DNA, 372 bp, Artificial Sequence
  Description of Artificial Sequence: Synthetic polynucleotide ABT2-35
gaggtgcagctgttggagtctgggggaggcttggtacagcctggggggtccctgcgtctctcctgtgcagcctccggattcacctttggtgagtatgatatggcttgggtccgccaggctccagggaagggtctagaatgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaatgggtggtgggcttgtttctcttcctcagtctaagtttgactactggggtcagggaaccctggtcaccgtctcgagc

SEQ ID NO: 613 - DNA, 369 bp, Artificial Sequence
  Description of Artificial Sequence: Synthetic polynucleotide ABT2-36
gaggtgcagctgttggagtctgggggaggcttggtacagcctggggggtccctgcgtctctcctgtgcagcctccggattcacctttcagtcgtatgatatgtgttgggtccgccaggctccagggaagggtctagagtgggtctcatgtatttatgcttatggtacgagtacatactacgcagactccgtgaagggccggttcaccatctcccgcgacaattccaagaacacgctgtatctgcaaatgaacagcctgcgtgccgaggacaccgcggtatattactgtgcgaaacctgctgttggtacgcatcgtcagcgggctgtttttgactactggggtcagggaaccctggtcaccgtctcgagc

SEQ ID NO: 614 - DNA, 369 bp, Artificial Sequence
  Description of Artificial Sequence: Synthetic polynucleotide ABT2-37
gaggtgcagctgttggagtctgggggaggcttggtacagcctggggggtccctgcgtctctcctgtgcagcctccggattcaccttttctcggtattcgatgatgtgggtccgccaggctccagggaagggtctagagtgggtctcagggattgattctacgggtgttcatacatactacgcagactccgtgaagggccggttcaccatctcccgcgacaattccaagaacacgctgtatctgcaaatgaacagcctgcgtgccgaggacaccgcggtatattactgtgcgaaaggtagttatgctctttggggtcgtgagccgacttttgactactggggtcagggaaccctggtcaccgtctcgagc

SEQ ID NO: 615 - DNA, 369 bp, Artificial Sequence
  Description of Artificial Sequence: Synthetic polynucleotide ABT2-38
gaggtgcagctgttggagtctgggggaggcttggtacagcctggggggtccctgcgtctctcctgtgcagcctccggattcacctttgatcggtatgcgatggggtgggtccgccaggttccagggaagggtctagagtgggtctcaacgattaatgttccgggtacgtttacatactacgcagactccgtgaagggccggttcaccatctcccgcgacaattccaagaacacgctgtatctgcaaatgaacagcctgcgtgccgaggataccgcggtatattactgtgcgaaagggcattttccgcgtggtggggcgattgttccttttgactactggggtcagggaaccctggtcaccgtctcgagc

SEQ ID NO: 616 - DNA, 372 bp, Artificial Sequence
  Description of Artificial Sequence: Synthetic polynucleotide ABT2-39
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaattgatcgggatgcgagtctgccgacgggggaggggtttgactactggggtcagggaaccctggtcaccgtctcgagc

SEQ ID NO: 617 - DNA, 369 bp, Artificial Sequence
  Description of Artificial Sequence: Synthetic polynucleotide ABT2-40
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaccgtgtgcgatttgtgatacggattcgttgggttttgactactggggtcagggaaccctggtcaccgtctcgagc

SEQ ID NO: 618 - DNA, 369 bp, Artificial Sequence
  Description of Artificial Sequence: Synthetic polynucleotide ABT2-41
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaactactgatattaataagaggtggcctactgggtttgactactggggtcagggaaccctggtcaccgtctcgagc

SEQ ID NO: 619 - DNA, 354 bp, Artificial Sequence
  Description of Artificial Sequence: Synthetic polynucleotide ABT2-64
gaggtgcagctgttggagtctgggggaggcttggtacagcctggggggtccctgcgtctctcctgtgcagcctccggattcacctttgatgattatgggatgggttgggtccgccaggctccagggaagggtcttgagtgggtctcacttatttatccgtttggtggggggacatactacgcagactccgtgaagggccggttcaccatctcccgcgacaattccaagaacacgctgtatctgcaaatgaacagcctgcgtgccgaggataccgcggtatattactgtgcgaaagttacgcagactggtaagtttgactactggggtcagggaaccctggtcaccgtctcgagc

SEQ ID NO: 620 - DNA, 369 bp, Artificial Sequence
  Description of Artificial Sequence: Synthetic polynucleotide ABT2-65
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 621 - DNA, 369 bp, Artificial Sequence
  Description of Artificial Sequence: Synthetic polynucleotide ABT2-65-1
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaagagcctgcgtgccgaggacaccgcggtatattactgtgcgcaaaatctggttcgtactcagtctaagatgtggatgtttgactactggggtcagggaaccctggtcaccgtctcgagc

SEQ ID NO: 622 - DNA, 369 bp, Artificial Sequence
  Description of Artificial Sequence: Synthetic polynucleotide ABT2-65-2
gaggtgcagctgttggagtctgggggaggcttggtacagcctggggggtccctgcgtctctcctgtgcagcctccggattcaccttttctacttataatatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaataatctggttcgtactcagtctaagatgtggatgtttgactactggggtcagggaaccctggtcaccgtctcgagc

SEQ ID NO: 623 - DNA, 369 bp, Artificial Sequence
  Description of Artificial Sequence: Synthetic polynucleotide ABT2-65-6
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 624 - DNA, 369 bp, Artificial Sequence
  Description of Artificial Sequence: Synthetic polynucleotide ABT2-65-7
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctacgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggacgaggattaagatgtggatgtttgactactggggtcagggaaccctggtcaccgtctcgagc

SEQ ID NO: 625 - DNA, 369 bp, Artificial Sequence
  Description of Artificial Sequence: Synthetic polynucleotide ABT2-65-8
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtttattactgtgcgcaaaatctggttcgtatggatagtaggcgttggatgtttgactactggggtcagggaaccctggtcaccgtctcgagc

SEQ ID NO: 626 - DNA, 369 bp, Artificial Sequence
  Description of Artificial Sequence: Synthetic polynucleotide ABT2-65-9
gaggtgcagctgttggagtctgggggaggcttggtacatcctggggggtccctgcgtctctcctgtgcagcctccggattcacctttcgttggtatccgatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtactcagtctaagatgtggatgtttgactactggggtcagggaaccctggtcaccgtctcgagc

SEQ ID NO: 627 - DNA, 368 bp, Artificial Sequence
  Description of Artificial Sequence: Synthetic polynucleotide ABT2-65-10
aggtgcagctgtcggagtctgggggaggcttggtacagcctggggggtccctgcgtctctcctgtgcagcctctggattcacctttacggagtataatatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaataatctggttcgtactcagtctaagatgtggatgtttgactactggggtcagggaaccctggtcaccgtctcgagc

SEQ ID NO: 628 - DNA, 369 bp, Artificial Sequence
  Description of Artificial Sequence: Synthetic polynucleotide ABT2-65-11
gaggtgcagctgttggagtctgggggaggcttggtacagcctggggggtccctgcgtctctcctgtgcagcctccggattcacctttagggcgtatcctatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaataatctggttcgtactcagtctaagatgtggatgtttgactactggggtcagggaaccctggtcaccgtctcgagc

SEQ ID NO: 629 - DNA, 369 bp, Artificial Sequence
  Description of Artificial Sequence: Synthetic polynucleotide ABT2-65-12
gaggtgcagctgttggagtctgggggaggcttggtacagcctggggggtccctgcgtctctcctgtgcagcctccggattcacctttcgggagtattggatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaacaatctggttcgtactcagtctaagatgtggatgtttgactactggggtcagggaaccctggtcaccgtctcgagc

SEQ ID NO: 630 - DNA, 369 bp, Artificial Sequence
  Description of Artificial Sequence: Synthetic polynucleotide ABT2-65-13
gaggtgcagctgttggagtctgggggaggcttggtacagcctggggggtccctgcgtctctcctgtgcagcctccggattcacctttagggagtatcagatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaataatctggttcgtactcagtctaagatgtggatgtttgactactggggtcagggaaccctggtcaccgtctcgagc

SEQ ID NO: 631 - DNA, 369 bp, Artificial Sequence
  Description of Artificial Sequence: Synthetic polynucleotide ABT2-65-14
gaggtgcagctgttggagtccgggggaggcttggtacagcctggggggtccctgcgtctctcctgtgcagcccccggattcacctttccgtattatccgatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 632 - DNA, 369 bp, Artificial Sequence
  Description of Artificial Sequence: Synthetic polynucleotide ABT2-65-15
gaggtgcagctgttggagtctgggggaggcttggtacagcctggggggtccctgcgtctctcctgtgcagcctccggattcacctttggtatttatcagatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 633 - DNA, 369 bp, Artificial Sequence
  Description of Artificial Sequence: Synthetic polynucleotide ABT2-65-16
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaagtggaggagtgcggagtggatgtttgactactggggtcagggaaccctggtcaccgtctcgagc

SEQ ID NO: 634 - DNA, 369 bp, Artificial Sequence
  Description of Artificial Sequence: Synthetic polynucleotide ABT2-65-17
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 635 - DNA, 369 bp, Artificial Sequence
  Description of Artificial Sequence: Synthetic polynucleotide ABT2-65-18
gaggtgcagctgttggagtctgggggaggcttggtacagcctggggggtccctgcgtctctcctgtgcagcctccggattcacctttggggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcagtggaggattggtgcgtggatgtttgactactggggtcagggaaccctggtcaccgtctcgagc

SEQ ID NO: 636 - DNA, 369 bp, Artificial Sequence
  Description of Artificial Sequence: Synthetic polynucleotide ABT2-65-19
gaggtgcagctgttggagtctgggggaggcttggtacagcctggggggtccctgcgtctctcctgtgcagcctccggattcacctttgaggattatcagatggggtgggtccgccaggctccagggaagggtcaagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttttttatgatgcgatgaggtggatgtttgactactggggtcagggaaccctggtcaccgtctcgagc

SEQ ID NO: 637 - DNA, 369 bp, Artificial Sequence
  Description of Artificial Sequence: Synthetic polynucleotide ABT2-65-20
gaggcgcagctgttggagtctgggggaggcttggtacagcctggggggtccctgcgtctctcctgtgcagcctccggattcacctttgaggattatcagatggggtgggtccgccaggctccagggaagggtctagagtgggtctcagttattagtcagttgggttggaatacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 638 - DNA, 369 bp, Artificial Sequence
  Description of Artificial Sequence: Synthetic polynucleotide ABT2-65-21
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcagctatttcgcagctgggttggcatacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 639 - DNA, 369 bp, Artificial Sequence
  Description of Artificial Sequence: Synthetic polynucleotide ABT2-65-22
gaggtgcagctgttggagtctgggggaggcttggtacagcctggggggtccctgcgtctctcctgtgcagcctccggattcacctttcttgggtatccgatgggttgggtccgccaggctccagggaagggtctagagtgggtctcatcgatttcggctatgggtaatcggacatactacgcagactccgtgaagggccggttcaccatctctcccgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 640 - DNA, 369 bp, Artificial Sequence
  Description of Artificial Sequence: Synthetic polynucleotide ABT2-65-23
gaggtgcagctgttggagtctgggggaggcttggtacagcctggggagtccctgcgtctctcctgtgcagcctccggattcacctttaaggtgtatcctatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 641 - DNA, 369 bp, Artificial Sequence
  Description of Artificial Sequence: Synthetic polynucleotide ABT2-65-24
gaggtgcagctgttggagtctgggggaggcttggtacagcctggggggtccctgcgtctctcctgtgcagcctccggattcacctttgcggcttatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 642 - DNA, 369 bp, Artificial Sequence
  Description of Artificial Sequence: Synthetic polynucleotide ABT2-65-25
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgttatcgtagttattattggatgtttgactactggggtcagggaaccctggtcaccgtcttgagc

SEQ ID NO: 643 - DNA, 369 bp, Artificial Sequence
  Description of Artificial Sequence: Synthetic polynucleotide ABT2-65-26
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttctggtgcgttcgggttattggatgtttgactactggggtcagggaaccctggtcaccgtctcgagc

SEQ ID NO: 644 - DNA, 369 bp, Artificial Sequence
  Description of Artificial Sequence: Synthetic polynucleotide ABT2-65-27
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtctgtggaagggtaggtggatgtttgactactggggtcagggaaccctggtcaccgtctcgagc

SEQ ID NO: 645 - DNA, 369 bp, Artificial Sequence
  Description of Artificial Sequence: Synthetic polynucleotide ABT2-65-28
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcagtttcgtcgttctcagtggatgtttgattactggggtcagggaaccctggtcaccgtctcgagc

SEQ ID NO: 646 - DNA, 369 bp, Artificial Sequence
  Description of Artificial Sequence: Synthetic polynucleotide ABT2-65-29
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttttggttcgggttgggtggtggatgtttgactactggggtcagggaaccctggtcaccgtctcgagc

SEQ ID NO: 647 - DNA, 369 bp, Artificial Sequence
  Description of Artificial Sequence: Synthetic polynucleotide ABT2-65-30
gaggtgcggctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtctgaataggagggattggatgtttgactactggggtcagggaaccctggtcaccgtctcgagc

SEQ ID NO: 648 - DNA, 369 bp, Artificial Sequence
  Description of Artificial Sequence: Synthetic polynucleotide ABT2-65-31
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaagattatgaggttgaagtggatgtttgactactggggtcagggaaccctggtcaccgtctcgagc

SEQ ID NO: 649 - DNA, 369 bp, Artificial Sequence
  Description of Artificial Sequence: Synthetic polynucleotide ABT2-65-32
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttgcggtgtcgcggggtcggtggatgtttgactactggggtcagggaaccctggtcaccgtctcgagc

SEQ ID NO: 650 - DNA, 369 bp, Artificial Sequence
  Description of Artificial Sequence: Synthetic polynucleotide ABT2-65-33
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggtatatgaagtctcagtggatgtttgactactggggtcagggaaccctggtcaccgtctcgagc

SEQ ID NO: 651 - DNA, 369 bp, Artificial Sequence
  Description of Artificial Sequence: Synthetic polynucleotide ABT2-65-34
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactaggtctaagaggtggatgtttgactactggggtcagggaaccctggtcaccgtctcgagc

SEQ ID NO: 652 - DNA, 369 bp, Artificial Sequence
  Description of Artificial Sequence: Synthetic polynucleotide ABT2-65-35
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctgaggaggtctaggtggatgtttgactactggggtcagggaaccctggtcacagtctcgagc

SEQ ID NO: 653 - DNA, 369 bp, Artificial Sequence
  Description of Artificial Sequence: Synthetic polynucleotide ABT2-65-36
gaggtgcggctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 654 - DNA, 369 bp, Artificial Sequence
  Description of Artificial Sequence: Synthetic polynucleotide ABT2-65-37
gaggtgcagctgttggagtctgggggaggcttagtacagcctggggggtccctgcgtctctcctgtgcagcctccggattcacctttgcggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 655 - DNA, 369 bp, Artificial Sequence
  Description of Artificial Sequence: Synthetic polynucleotide ABT2-65-38
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctaccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 656 - DNA, 369 bp, Artificial Sequence
  Description of Artificial Sequence: Synthetic polynucleotide ABT2-65-39
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgggaaatctggttcgtactcagtctaagatgtggatgtttgactactggggtcagggaaccctggtcaccgtctcgagc

SEQ ID NO: 657 - DNA, 369 bp, Artificial Sequence
  Description of Artificial Sequence: Synthetic polynucleotide ABT2-65-40
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaagacgtttaagagtaggtggatgtttgactactggggtcagggaaccctggtcaccgtctcgagc

SEQ ID NO: 658 - DNA, 369 bp, Artificial Sequence
  Description of Artificial Sequence: Synthetic polynucleotide ABT2-65-41
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatgggtgactcgtactcagtctaagctggggctgtttgactactggggtcagggaaccctggtcaccgtctcgagc

SEQ ID NO: 659 - DNA, 369 bp, Artificial Sequence
  Description of Artificial Sequence: Synthetic polynucleotide ABT2-65-42
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatgggtgactcgtactcagtctaagttgggtcggtttgactactggggtcagggaaccctggtcaccgtctcgagc

SEQ ID NO: 660 - DNA, 369 bp, Artificial Sequence
  Description of Artificial Sequence: Synthetic polynucleotide ABT2-65-43
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggaggtatcgtattcagtctaagctggggctgtttgactactggggtcagggaaccctggtcaccgtctcgagc

SEQ ID NO: 661 - DNA, 369 bp, Artificial Sequence
  Description of Artificial Sequence: Synthetic polynucleotide ABT2-65-44
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggttgggtcgtattcagtctaagttgggtctgtttgactactggggtcagggaaccctggtcaccgtctcgagc

SEQ ID NO: 662 - DNA, 369 bp, Artificial Sequence
  Description of Artificial Sequence: Synthetic polynucleotide ABT2-65-45
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggcgtcggcgtactcagtctaagctggggtattttgactactggggtcagggaaccctggtcaccgtctcgagc

SEQ ID NO: 663 - DNA, 369 bp, Artificial Sequence
  Description of Artificial Sequence: Synthetic polynucleotide ABT2-65-46
gaggtgcagctgttggagtctgggggaggcttggtacagcctggggggtccctgcgtctctcctgtgcagcctccggattcacctttgaggattatcagatggggtgggtccgccaggctccagggaagggtttagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggttgacgcgtactcagtctaagttggggtattttgactactggggtcaaggaaccctggtcaccgtctcgagc

SEQ ID NO: 664 - DNA, 369 bp, Artificial Sequence
  Description of Artificial Sequence: Synthetic polynucleotide ABT2-65-47
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggaggaagcgtactcagtctaagcttggttattttgactactggggtcagggaaccctggtcaccgtctcgagc

SEQ ID NO: 665 - DNA, 369 bp, Artificial Sequence
  Description of Artificial Sequence: Synthetic polynucleotide ABT2-65-48
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaatggcagatgcgtactcagtctaagcttggttattttgactactggggtcagggaaccctggtcaccgtctcgagc

SEQ ID NO: 666 - DNA, 369 bp, Artificial Sequence
  Description of Artificial Sequence: Synthetic polynucleotide ABT2-65-49
ggggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 667 - DNA, 369 bp, Artificial Sequence
  Description of Artificial Sequence: Synthetic polynucleotide ABT2-65-50
gaggtgcagctgttggagtctgggggaggcttggtacagcctggggggtccctgcgtctctcctgtgcagcctccggattcacctttctgacgtatccgatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcggggaaccctggtcaccgtctcgagc

SEQ ID NO: 668 - DNA, 369 bp, Artificial Sequence
  Description of Artificial Sequence: Synthetic polynucleotide ABT2-65-52
gaggtgcaggtgttggagtctgggggaggcttggtacagcctggggggtccctgcgtctctcctgtgcagcctccggattcaccttttatagttatcctatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 669 - DNA, 369 bp, Artificial Sequence
  Description of Artificial Sequence: Synthetic polynucleotide ABT2-65-53
gaggtgcagctgttggagtctgggggaggcttggtacagcctggggggtccctgcgtctctcctgtgcagcctccggattcaccttttatgtttatcctatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgctgaggacaccgcggtatattactgtgcgataaatctggttcgtactcagtctaagatgtggatgtttgactactggggtcagggaaccctggtcaccgtctcgagc

SEQ ID NO: 670 - DNA, 369 bp, Artificial Sequence
  Description of Artificial Sequence: Synthetic polynucleotide ABT2-65-54
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcaactattagtcagttgggttggatgacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtttgactactggggtcagggaaccctggtcaccgtctcgagc

SEQ ID NO: 671 - DNA, 369 bp, Artificial Sequence
  Description of Artificial Sequence: Synthetic polynucleotide ABT2-65-55
gaggtgcagctgttggagtctgggggaggcttggcacagcctggggggtccctgcgtctctcctgtgcagcctccggattcacctttgaggattatcagatggggtgggtccgccaggctccagggaagggtctagagtgggtctcagcgattactcagcttggttggtatacatactacgcagactccgtgaagggccggttcaccatctcccgcgacgattccaagaacacgctgtatctgcaaatgaacagcctgcgtgccgaggacaccgcggtatattactgtgcgaaaaatctggttcgtactcagtctaagatgtggatgtatgactactggggtcagggaaccctggtcaccgtctcgagc

SEQ ID NO: 672 - DNA, 369 bp, Artificial Sequence
  Description of Artificial Sequence: Synthetic polynucleotide ABT2-65-56
gaggtgcagttgttggagtctgggggaggcttggtacagcctggggggtccctgcgtctctcctgtgcagcctccggattcacctttcctgagtattatatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 673 - DNA, 369 bp, Artificial Sequence
  Description of Artificial Sequence: Synthetic polynucleotide ABT2-65-57
gaggtgcagctgttggagtctgggggaggcttggtacagcctggggggtccctgcgtctctcctgtgcagcctccggattcacctttagggagtatggtatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 674 - DNA, 369 bp, Artificial Sequence
  Description of Artificial Sequence: Synthetic polynucleotide ABT2-65-58
gaggtgcagctgttggagtctgggggaggcttggtacagcctggggggtccctgcgtctctcctgtgcagcctccggattcacctttgttatttatccgatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 675 - DNA, 369 bp, Artificial Sequence
  Description of Artificial Sequence: Synthetic polynucleotide ABT2-65-59
gaggtgcagctgttggagtctgggggaggcttggtacagcctggggggtccctgcgtctctcctgtgcagcctccggattcacctttgatacttattggatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 676 - DNA, 369 bp, Artificial Sequence
  Description of Artificial Sequence: Synthetic polynucleotide ABT2-65-60
gaggtgcagctgttggagtctgggggaggcttggtacagcctggggggtccctgcgtctctcctgtgcagcctccggattcacctttagtatgtatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 677 - DNA, 369 bp, Artificial Sequence
  Description of Artificial Sequence: Synthetic polynucleotide ABT2-65-61
gaggtgcagctgttggagtctgggggaggcttggtacagcctggggggtccctgcgtctctcctgtgcagcctccggattcacctttagggagtatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 678 - DNA, 369 bp, Artificial Sequence
  Description of Artificial Sequence: Synthetic polynucleotide ABT2-65-62
gaggtgcagctgttggagtctgggggaggcttggtacagcctggggggtccctgcgtctctcctgtgcagcctccggattcacctttcgggagtattttatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 679 - DNA, 369 bp, Artificial Sequence
  Description of Artificial Sequence: Synthetic polynucleotide ABT2-65-63
gaggtgcagctgttggagtctgggggaggcttggtacagcctggggggtccctgcgtctctcctgtgcagcctccggattcacctttgatggttataatatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 680 - DNA, 369 bp, Artificial Sequence
  Description of Artificial Sequence: Synthetic polynucleotide ABT2-65-64
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcaagtattaggactcctggtaagtttacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 681 - DNA, 369 bp, Artificial Sequence
  Description of Artificial Sequence: Synthetic polynucleotide ABT2-65-65
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatctattagtgtggctggtaagcctacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 682 - DNA, 369 bp, Artificial Sequence
  Description of Artificial Sequence: Synthetic polynucleotide ABT2-65-66
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcaactattgcgctgctgggtgggcctacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 683 - DNA, 369 bp, Artificial Sequence
  Description of Artificial Sequence: Synthetic polynucleotide ABT2-65-67
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcaacgattcaggtttttggtggtaagacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 684 - DNA, 369 bp, Artificial Sequence
  Description of Artificial Sequence: Synthetic polynucleotide ABT2-65-68
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcaagtattcggccgactggtccgtttacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 685 - DNA, 369 bp, Artificial Sequence
  Description of Artificial Sequence: Synthetic polynucleotide ABT2-65-69
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatctatttatagtcgtggtacgcctacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 686 - DNA, 369 bp, Artificial Sequence
  Description of Artificial Sequence: Synthetic polynucleotide ABT2-65-70
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgattccgagggtgggtatgcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 687 - DNA, 369 bp, Artificial Sequence
  Description of Artificial Sequence: Synthetic polynucleotide ABT2-65-71
gaggtgcagctgttggagtctgggggaggcttggtacagcctggggggtccctgcgtctctcctgtatagcctccggattcacctttgaggattatcagatggggtgggtccgccaggctccagggaagggtctagagtgggtctcagctattcggaatgttggtagggctacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 688 - DNA, 369 bp, Artificial Sequence
  Description of Artificial Sequence: Synthetic polynucleotide ABT2-65-72
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcagtgattggttttcctggtaggctgacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 689 - DNA, 369 bp, Artificial Sequence
  Description of Artificial Sequence: Synthetic polynucleotide ABT2-65-73
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgattcgggcggttggtgttggtacatactacgcagactccgtgaagggccggttcaccatctcccgcgacgattccaaggacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 690 - DNA, 369 bp, Artificial Sequence
  Description of Artificial Sequence: Synthetic polynucleotide ABT2-65-74
gaggtgcagctgttggagtctgggggaggcttggtacagcctggggggtccctgcgtctctcctgtgcagcctccggattcacctttcagcattattatatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcgtactcagtctaagatgtggatgtttgactactggggtcagggaaccctggtcaccgtctcgagc

SEQ ID NO: 691 - DNA, 369 bp, Artificial Sequence
  Description of Artificial Sequence: Synthetic polynucleotide ABT2-65-75
gaggtgcagctgttggagtctgggggaggcttggtacagcatggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaagtctaggtggatgtttgactactggggtcagggaaccctggtcacagtctcgagc

SEQ ID NO: 692 - DNA, 369 bp, Artificial Sequence
  Description of Artificial Sequence: Synthetic polynucleotide ABT2-65-76
gaggtgcagctgttggagtctgggggaggcttggtacagcctggggggtccctgcgtctctcctgtgtagcctccggattcacctttgaggattatcagatggggtgggtccgccaggctccggggaagggtctagagtgggtcacatcgatttcggctatgggtaatcggacatactacgcagactccgtgaagggccggttcaccatctcccgcgacgattccaagaacacgctgtacctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 693 - DNA, 369 bp, Artificial Sequence
  Description of Artificial Sequence: Synthetic polynucleotide ABT2-65-77
gaggtgcagctgttggagtctgggggaggcttggtacagcatggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccttggtcactgtctcgagc

SEQ ID NO: 694 - DNA, 369 bp, Artificial Sequence
  Description of Artificial Sequence: Synthetic polynucleotide ABT2-65-78
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggacgtctaggtggatgtttgactactggggtcagggagccctggtcacagtctcgagc

SEQ ID NO: 695 - DNA, 369 bp, Artificial Sequence
  Description of Artificial Sequence: Synthetic polynucleotide ABT2-65-79
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccggggacaccgcggtatattactgtgcgcaaaatctggttaggctggggaggtctaggtggatgtttgactactggggtcagggaaccatggtcacagtctcgagc

SEQ ID NO: 696 - DNA, 369 bp, Artificial Sequence
  Description of Artificial Sequence: Synthetic polynucleotide ABT2-65-80
gaggtgcagctgttggagtctgggggaggcttggtacagcctggggggtccctgcgtctcgcctgtgtagcctccggattcacctttgaggattatcagatggggtgggtccgccaggctccagggaagggtctagagtgggtctcatcgatttcggctatgggtaatcggacatactacgcagactccgtgaagggtcggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 697 - DNA, 369 bp, Artificial Sequence
  Description of Artificial Sequence: Synthetic polynucleotide ABT2-65-81
gaggtgcagctgttggagtctgggggaggcttggtacagcctggggggtccctgcgtctctcctgtgtagcctccggattcacctttgaggaatatcagatggggtgggtccgccaggctccagggaagggtctagagtgggtctcatcgatttcggctatgggtaatcggacatactacgcagactccgtgaagggccggttcactatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 698 - DNA, 369 bp, Artificial Sequence
  Description of Artificial Sequence: Synthetic polynucleotide ABT2-65-82
gaggtgcagctgttggagtctgggggaggcttggtacggcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgatcccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 699 - DNA, 369 bp, Artificial Sequence
  Description of Artificial Sequence: Synthetic polynucleotide ABT2-65-83
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagccagcgtgccgaggacaccgcggtatattactgtgcgcaaaatctggttaggctggggaggtctaggtggatgtttgactactggggtcagggaaccctggtcacagtctcgagc

SEQ ID NO: 700 - DNA, 369 bp, Artificial Sequence
  Description of Artificial Sequence: Synthetic polynucleotide ABT2-65-84
gaggtgcagctgttggagtctgggggaggcttggtacagcctggggggtccctgcgtctctcctgtgtagcctccggattctcctttgaggattatcagatggggtgggtccgccaggctccacggaagggtctagagtggatctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 701 - DNA, 369 bp, Artificial Sequence
  Description of Artificial Sequence: Synthetic polynucleotide ABT2-65-85
gaggtgcagctgatggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaaccggacatactacgcagactccgtgaagggccggttcgccatctcccgcgacgattccaagaacacgctgtatctgcaaatgaacagcctgcgtgccaaggacaccgcggtatattactgtgcgcaaaatctggttaggctggggaggtctaggtggatgtttgactactggggtcagggaaccctggtcacagtctcgagc

SEQ ID NO: 702 - DNA, 369 bp, Artificial Sequence
  Description of Artificial Sequence: Synthetic polynucleotide ABT2-65-86
gaggtgcagctgttggagtctgggggaggcttggtacggcctggggggtcccagcgtctctcctgtgtagcctccggattcacctctgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 703 - DNA, 369 bp, Artificial Sequence
  Description of Artificial Sequence: Synthetic polynucleotide ABT2-65-87
gaggtgcagctgttggagtctgggggaggcttggtacagcctggggggtccctgcgtctctcctgtgtagcctccggattcacctttgaggattatcagatggggtgggtccgccaggctccagggaaggatctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 704 - DNA, 369 bp, Artificial Sequence
  Description of Artificial Sequence: Synthetic polynucleotide ABT2-65-88
gaggtgcagttgttggagtctgggggaggcttggtacagcctggggggtccctgcgtctctactgtgtagcctccggattcacctttgaggattatcagatggggtgggtccgccaggctccagggaagggtctagagtgggtctcatcgatttcggctatgggtaatcggacatactacgcagactccgtgaagggccggttcacaatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 705 - DNA, 369 bp, Artificial Sequence
  Description of Artificial Sequence: Synthetic polynucleotide ABT2-65-89
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgagccgaggacaccgcggtatattactgtgcgcaaaatatggttaggctggggaggtctaggtggatgtttgactactggggtcagggaaccctggtcacagtctcgagc

SEQ ID NO: 706 - DNA, 369 bp, Artificial Sequence
  Description of Artificial Sequence: Synthetic polynucleotide ABT2-65-90
gaggtgcagctgttggagtctgggggaggcttggtacagcctggggggtccctgcgtctctcctgtgtagcctccggattcacctttgaggattatcagatggggtgggtccgccaggctccagggaagggtcaagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcacggaaccctggtcacagtctcgagc

SEQ ID NO: 707 - DNA, 369 bp, Artificial Sequence
  Description of Artificial Sequence: Synthetic polynucleotide ABT2-65-113
gaggtgcagctgttggagtctgggggaggcttggtacagcctggggggtccctgcgtctctcctgtgcagcctccggattcacctttgtgcagtatcagatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 708 - DNA, 369 bp, Artificial Sequence
  Description of Artificial Sequence: Synthetic polynucleotide ABT2-65-114
gaggtgcagctgttggagtctgggggaggcttggtacagcctggggggtccctgcgtctctcctgtgcagcctccggattcacctttagggagtatatgatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 709 - DNA, 369 bp, Artificial Sequence
  Description of Artificial Sequence: Synthetic polynucleotide ABT2-65-115
gaggtgcagctgttggagtctgggggaggcttggtacagcctggggggtccctgcgtctctcctgtgcagcctccggattcacctttattgattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 710 - DNA, 369 bp, Artificial Sequence
  Description of Artificial Sequence: Synthetic polynucleotide ABT2-65-116
gaggtgcagctgttggagtctgggggaggcttggtacagcctggggggtccctgcgtctctcctgtgcagcctccggattcacctttgcgggttattatatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 711 - DNA, 369 bp, Artificial Sequence
  Description of Artificial Sequence: Synthetic polynucleotide ABT2-65-117
gaggtgcagctgttggagtctgggggaggcttggtacggcctggggggtccctgcgtctctcctgtgtagcctccggattcacctttgaggattatcagatggggtgggtccgccaggctccagggaagggtctagagtggatctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 712 - DNA, 369 bp, Artificial Sequence
  Description of Artificial Sequence: Synthetic polynucleotide ABT2-65-118
gaggtgcagctgttggagtctgggggaggcttggtacagcctggggggtccctgcgtctctcctgtgcagcctccggattcacctttgcgacttatacgatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 713 - DNA, 369 bp, Artificial Sequence
  Description of Artificial Sequence: Synthetic polynucleotide ABT2-65-119
gaggtgcagctgttggagtctgggggaggcttggtacagcctggggggtccctgcgtctctcctgtgcagcctccggattcacctttattgcgtatccgatgggttgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 714 - DNA, 369 bp, Artificial Sequence
  Description of Artificial Sequence: Synthetic polynucleotide ABT2-65-120
gaggtgcagctgttggagtctgggggaggcctggtacagcctggggggtccctgcgtctctcctgtgtagcctccggattcacctttgaggattatcagatggggtgggtccgccaggctccagggaagggtctagagtgggtctcatcgatttctgctatgggtatgcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 715 - DNA, 369 bp, Artificial Sequence
  Description of Artificial Sequence: Synthetic polynucleotide ABT2-65-121
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatctattgcggctcatggtaataggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 716 - DNA, 369 bp, Artificial Sequence
  Description of Artificial Sequence: Synthetic polynucleotide ABT2-65-122
gaggtgcagctgttggagtctgggggaggcttggtacggcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 717 - DNA, 369 bp, Artificial Sequence
  Description of Artificial Sequence: Synthetic polynucleotide ABT2-65-123
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggagatactacgcagactccgtgaagggccggttcaccatctcccgcgacaattccaagaacacgctgtatctgcaaatgaacatcctgcgtgccgaggacaccgcggtatattactgtgcgcaaaatctggttaggctggggaggtctaggtgggtgtttgactactggggtcagggaaccctggtcacagtctcgagc

SEQ ID NO: 718 - DNA, 369 bp, Artificial Sequence
  Description of Artificial Sequence: Synthetic polynucleotide ABT2-65-124
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctgtgggtaatcggacatactacgcagactccgtgaagggccggttcaccatctcccgcgacgattccaagaacacgctgtatctgcaaatgaacagcctgcgtgccgaggacatcgcggtatattactgtgcgcaaaatctggttaggctggggaggtctaggtggatgtttgactactggggtcagggaaccctggtcacagtctcgagc

SEQ ID NO: 719 - DNA, 369 bp, Artificial Sequence
  Description of Artificial Sequence: Synthetic polynucleotide ABT2-65-125
gaggtgcagctgttggagtctgggggaggcttggtacagcctggggggtccctgcgtctctcctgtgtagcctccggattcacctttgaggattatcagatggggtgggtccgccaggctccagggaagggtctagagtggatctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 720 - DNA, 369 bp, Artificial Sequence
  Description of Artificial Sequence: Synthetic polynucleotide ABT2-65-126
gaggtgcagctgttggagtctgggggaggcttggtacagcctggggggtccctgcgtatctcctgtgtaacctccgggttcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgaatctgcaaatgaacagcctgcgtgccgaggacaccgcggtatattactgtgcgcaaaatctggttaggctggggaggtctaggtgggtgtttgactactggggtcagggaaccctggtcacagtctcgagc

SEQ ID NO: 721 - DNA, 369 bp, Artificial Sequence
  Description of Artificial Sequence: Synthetic polynucleotide ABT2-65-127
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtcacatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 722 - DNA, 369 bp, Artificial Sequence
  Description of Artificial Sequence: Synthetic polynucleotide ABT2-65-128
gaggtgcagctgttggagtctgggagaggcttggtacagcctggggggtccctgcgtctctcctgtgtagcctccggattcacctttgaggattatcagatggggtgggtccgccaggctccagggaagggtctagagtgggtctcatcgatttcggatatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 723 - DNA, 369 bp, Artificial Sequence
  Description of Artificial Sequence: Synthetic polynucleotide ABT2-65-129
gaggtgcagctgttggagtctgggggaggcttggtacagcctggggggtccctgcgtctctcctgtgtagcctccggtttcacctttgaggattatcagatggggtgggtccgccaggctccagggaagggtctagagtgggtctcaacggtttcggctatgggtaatcggacatactacgcagactccatgaagggccggttcaccatctctcgcgacgattccaagaacacgctgtatctgcaaatgaacagcctgcgtgcagaggacaccgcggtatattactgtgcgcaaaatctggttaggctggggaggtctaggtggatgtttgactactggggtcagggaaccctggtcacagtctcgagc

SEQ ID NO: 724 - DNA, 369 bp, Artificial Sequence
  Description of Artificial Sequence: Synthetic polynucleotide ABT2-65-130
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatggttaatcggacatactacgcagactccgtgaagggcaggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 725 - DNA, 369 bp, Artificial Sequence
  Description of Artificial Sequence: Synthetic polynucleotide ABT2-65-131
gaggtgcagctgttggagtctgggggaggcttggtacagcctcgggggtccctgcgtctctcctgtgtagcctccggattcacctttgaggattatcagatggggtgggtccgccaggctccaggcaagggtctagagtgggtctcatcgatttcgactatgggtaatcggacatactacgcagactccgtgaagggccggttcaccatctcccgcgacgattccaagaacacgctgtatctgcaaatgaacagcctgcgtgcagaggacaccgcggtatatcactgtgcgcaaaatctggttaggttggggaggtctaggtggatgtttgactactggggtcagggaaccctggtcacagtctcgagc

SEQ ID NO: 726 - DNA, 369 bp, Artificial Sequence
  Description of Artificial Sequence: Synthetic polynucleotide ABT2-65-132
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtcttgcttcgaggaggtggatgtttgactactggggtcagggaaccctggtcaccgtctcgagc

SEQ ID NO: 727 - DNA, 369 bp, Artificial Sequence
  Description of Artificial Sequence: Synthetic polynucleotide ABT2-65-133
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcattggaagagggggggttggatgtttgactactggggtcagggaaccctggtcaccgtctcgagc

SEQ ID NO: 728 - DNA, 369 bp, Artificial Sequence
  Description of Artificial Sequence: Synthetic polynucleotide ABT2-65-134
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaagttgtctaagagtcgttggatgtttgactactggggtcagggaaccctggtcaccgtctcgagc

SEQ ID NO: 729 - DNA, 369 bp, Artificial Sequence
  Description of Artificial Sequence: Synthetic polynucleotide ABT2-65-135
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaggattaagaagatgaagtggatgtttgactactggggtcagggaaccctggtcaccgtctcgagc

SEQ ID NO: 730 - DNA, 369 bp, Artificial Sequence
  Description of Artificial Sequence: Synthetic polynucleotide ABT2-65-136
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaagctgtcgcgtactgagtggatgtttgactactggggtcagggaaccctggtcaccgtctcgagc

SEQ ID NO: 731 - DNA, 369 bp, Artificial Sequence
  Description of Artificial Sequence: Synthetic polynucleotide ABT2-65-137
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggtttaccatctcccgcgacgattccaagaacacgctgtatctgcaaatgaacagcctgcgtgccgaggacaccgcggtatattactgtgcggaaaatctggttcggacggctaagcgtaggtggatgtttgactactggggtcagggaaccctggtcaccgtctcgagc

SEQ ID NO: 732 - DNA, 369 bp, Artificial Sequence
  Description of Artificial Sequence: Synthetic polynucleotide ABT2-65-138
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgggttacggcgcggaagtggatgtttgactactggggtcagggaaccctggtcaccgtctcgagc

SEQ ID NO: 733 - DNA, 369 bp, Artificial Sequence
  Description of Artificial Sequence: Synthetic polynucleotide ABT2-65-139
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttagggtgcgtgtgcgtcggtggatgtttgactactggggtcagggaaccctggtcaccgtctcgagc

SEQ ID NO: 734 - DNA, 369 bp, Artificial Sequence
  Description of Artificial Sequence: Synthetic polynucleotide ABT2-65-140
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaagatttcgaggcgtcattggatgtttgactactggggtcagggaaccctggtcaccgtctcgagc

SEQ ID NO: 735 - DNA, 369 bp, Artificial Sequence
  Description of Artificial Sequence: Synthetic polynucleotide ABT2-65-141
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaggattaagcagacgaagtggatgtttgactactggggtcagggaaccctggtcaccgtctcgagc

SEQ ID NO: 736 - DNA, 369 bp, Artificial Sequence
  Description of Artificial Sequence: Synthetic polynucleotide ABT2-65-142
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaagatttctgcgagggagtggatgtttgactactggggtcagggaaccctggtcaccgtctcgagc

SEQ ID NO: 737 - DNA, 369 bp, Artificial Sequence
  Description of Artificial Sequence: Synthetic polynucleotide ABT2-65-143
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtctgcagagggataggtggatgtttgactactggggtcagggaaccctggtcaccgtctcgagc

SEQ ID NO: 738 - DNA, 369 bp, Artificial Sequence
  Description of Artificial Sequence: Synthetic polynucleotide ABT2-65-144
gaggtgcagctgttggagtctgggggaggcttggtacagcctggggggtccctgcgtctctcctgtgcagcctccggattcacctttgaggattatcagatggggtgggtgcgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtatttcgaagaagcagtggatgtttgactactggggtcagggaaccctggtcaccgtctcgagc

SEQ ID NO: 739 - DNA, 369 bp, Artificial Sequence
  Description of Artificial Sequence: Synthetic polynucleotide ABT2-65-145
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaggattcagaaggttaagtggatgtttgactactggggtcagggaaccctggtcaccgtctcgagc

SEQ ID NO: 740 - DNA, 369 bp, Artificial Sequence
  Description of Artificial Sequence: Synthetic polynucleotide ABT2-65-146
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaggactatgaagcggaagtggatgtttgactactggggtcagggaaccctggtcaccgtctcgagc

SEQ ID NO: 741 - DNA, 369 bp, Artificial Sequence
  Description of Artificial Sequence: Synthetic polynucleotide ABT2-65-147
gaggtgcagctgttggagtctgggggtggcttggtgcagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcggcttgggcggattcgttggatgtttgactactggggtcagggaaccctggtcaccgtctcgagc

SEQ ID NO: 742 - DNA, 369 bp, Artificial Sequence
  Description of Artificial Sequence: Synthetic polynucleotide ABT2-65-148
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcggcttgggtcgaagaggtggatgtttgactactggggtcagggaaccctggtcaccgtctcgagc

SEQ ID NO: 743 - DNA, 369 bp, Artificial Sequence
  Description of Artificial Sequence: Synthetic polynucleotide ABT2-65-149
gaggtgcagctgttggagtctgggggaggcttggtacagcctggggggtccctgcgtctctcctgtgcagcctccggattcacctttgaggattatcagatggggtgggtccgccaggctccaggaaagggtctagagtgggtctcgtcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgtgttgataggaggcggtggatgtttgactactggggtcagggaaccctggtcaccgtctcgagc

SEQ ID NO: 744 - DNA, 369 bp, Artificial Sequence
  Description of Artificial Sequence: Synthetic polynucleotide ABT2-65-150
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttctgattgcgcgtggtaagtggatgtttgactactggggtcagggaaccctggtcaccgtctcgagc

SEQ ID NO: 745 - DNA, 369 bp, Artificial Sequence
  Description of Artificial Sequence: Synthetic polynucleotide ABT2-65-151
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgttggaggaagcatgcgtggatgtttgactactggggtcagggaaccctggtcaccgtctcgagc

SEQ ID NO: 746 - DNA, 369 bp, Artificial Sequence
  Description of Artificial Sequence: Synthetic polynucleotide ABT2-65-152
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgttggaagagttcggcgtggatgtttgactactggggtcagggaaccctggtcaccgtctcgagc

SEQ ID NO: 747 - DNA, 369 bp, Artificial Sequence
  Description of Artificial Sequence: Synthetic polynucleotide ABT2-65-154
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacacactacgcagactccgtgaagggccggttcaccatctcccgcgacgattccaagaacacgctgtatctgcaaatgaacagcctgcgtgccgaggacaccgcggtatattactgtgcgcaaaatctggttaggattcgtaggacgaagtggatgtttgactactggggtcagggaaccctggtcaccgtctcgagc

SEQ ID NO: 748 - DNA, 369 bp, Artificial Sequence
  Description of Artificial Sequence: Synthetic polynucleotide ABT2-65-155
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttttggttcagaggaggaagtggatgtttgactactggggtcagggaaccctggtcaccgtctcgagc

SEQ ID NO: 749 - DNA, 369 bp, Artificial Sequence
  Description of Artificial Sequence: Synthetic polynucleotide ABT2-65-156
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcggattgggcggaataagtggatgtttgactactggggtcagggaaccctggtcaccgtctcgagc

SEQ ID NO: 750 - DNA, 369 bp, Artificial Sequence
  Description of Artificial Sequence: Synthetic polynucleotide ABT2-65-157
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacatgctgtatctgcaaatgaacagcctgcgtgccgaggacaccgcggtatattactgtgcggaaaatctggttcggcttagtctgcatcggtggatgtttgactactggggtcagggaaccctggtcaccgtctcgagc

SEQ ID NO: 751 - DNA, 369 bp, Artificial Sequence
  Description of Artificial Sequence: Synthetic polynucleotide ABT2-65-158
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaagtggaagagggatttttggatgtttgactactggggtcagggaaccctggtcaccgtctcgagc

SEQ ID NO: 752 - DNA, 369 bp, Artificial Sequence
  Description of Artificial Sequence: Synthetic polynucleotide ABT2-65-159
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttagggtgagtaaggcgaggtggatgtttgactactggggtcagggaaccctggtcaccgtctcgagc

SEQ ID NO: 753 - DNA, 369 bp, Artificial Sequence
  Description of Artificial Sequence: Synthetic polynucleotide ABT2-65-160
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtccccggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 754 - DNA, 369 bp, Artificial Sequence
  Description of Artificial Sequence: Synthetic polynucleotide ABT2-65-163
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtgggcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 755 - DNA, 369 bp, Artificial Sequence
  Description of Artificial Sequence: Synthetic polynucleotide ABT2-65-166
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtggacggacatactacgcagactccgtgaagggccggttcaccatctcccgcgacaattccaagaacacgctgtatctgcaaatgaacagcctgcgtgccgaggacaccgcggtatattactgtgcgcaaaatctggttaggctggggaggtctaggtggatgtttgactactggggtcagggaaccctggtcacagtctcgagc

SEQ ID NO: 756 - DNA, 369 bp, Artificial Sequence
  Description of Artificial Sequence: Synthetic polynucleotide ABT2-65-167
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcggtggaagaagaatgagtggatgtttgactactggggtcagggaaccctggtcaccgtctcgagc

SEQ ID NO: 757 - DNA, 369 bp, Artificial Sequence
  Description of Artificial Sequence: Synthetic polynucleotide ABT2-65-168
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggtggaagttggagtcttggatgtttgactactggggtcagggaaccctggtcaccgtctcgagc

SEQ ID NO: 758 - DNA, 369 bp, Artificial Sequence
  Description of Artificial Sequence: Synthetic polynucleotide ABT2-65-169
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaattggcggcgtgggtcttggatgtttgactactggggtcagggaaccctggtcaccgtctcgagc

SEQ ID NO: 759 - DNA, 369 bp, Artificial Sequence
  Description of Artificial Sequence: Synthetic polynucleotide ABT2-65-170
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcgggttcttcttaataagtggatgtttgactactggggtcagggaaccctggtcaccgtctcgagc

SEQ ID NO: 760 - DNA, 369 bp, Artificial Sequence
  Description of Artificial Sequence: Synthetic polynucleotide ABT2-65-171
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttcggttgaataggtcgcagtggatgtttgactactggggtcagggaaccctggtcaccgtctcgagc

SEQ ID NO: 761 - DNA, 369 bp, Artificial Sequence
  Description of Artificial Sequence: Synthetic polynucleotide ABT2-65-172
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttcggtggaagaagggttcttggatgtttgactactggggtcagggaaccctggtcaccgtctcgagc

SEQ ID NO: 762 - DNA, 369 bp, Artificial Sequence
  Description of Artificial Sequence: Synthetic polynucleotide ABT2-65-173
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggtttcgggcgaaggagtggatgtttgactactggggtcagggaaccctggtcaccgtctcgagc

SEQ ID NO: 763 - DNA, 369 bp, Artificial Sequence
  Description of Artificial Sequence: Synthetic polynucleotide ABT2-65-174
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggtttaagaagacgcagtggatgtttgactactggggtcagggaaccctggtcaccgtctcgagc

SEQ ID NO: 764 - DNA, 369 bp, Artificial Sequence
  Description of Artificial Sequence: Synthetic polynucleotide ABT2-65-175
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcggaaaatctggttaggattgcgggggatcggtggatgtttgactactggggtcagggaaccctggtcaccgtctcgagc

SEQ ID NO: 765 - DNA, 369 bp, Artificial Sequence
  Description of Artificial Sequence: Synthetic polynucleotide ABT2-65-176
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtagtcggacatactacgcagactccgtgaagggccggttcaccatctcccgcgacgattccaagaacacgctgtatctgcaaatgaacagcctgcgtgccgaggacaccgcggtatattactgtgcggaaaatctggttaaggtggcgcggggtcgttggatgtttgactactggggtcagggaaccctggtcaccgtctcgagc

SEQ ID NO: 766 - DNA, 369 bp, Artificial Sequence
  Description of Artificial Sequence: Synthetic polynucleotide ABT2-65-177
gaggtgcagctgttggagtctgggggaggcttggtacagcctggggggtccctgcgtctctcctgtgcagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcttgcgtgccgaggacaccgcggtatattactgtgcgcaaaatctggttaggtttaaggtgctgcagtggatgtttgactactggggtcagggaaccctggtcaccgtctcgagc

SEQ ID NO: 767 - DNA, 369 bp, Artificial Sequence
  Description of Artificial Sequence: Synthetic polynucleotide ABT2-65-500
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacggttccaagaacacgctgtatctgcaaatgaacagcctgcgtgccgaggacaccgcggtatattactgtgcgcaaaatctggttaggctgggggggtctaggtggatgtttgactactggggtcagggaaccctggtcaccgtcttgagc

SEQ ID NO: 768 - DNA, 369 bp, Artificial Sequence
  Description of Artificial Sequence: Synthetic polynucleotide ABT2-65-501
gaggtgcagctgttggagtctgggggaggcttggtacagcctggggggtccctgcgtctctcctgtgtagcctccggattcgcctttgaggattatcagatggggtgggtccgccaggctccagggaagggtctagagtgggtctcatcgatttcggctatgggtaatcggacatactacgcagactccgtgaggggccggttcaccatctcccgcgacggttccaagaacacgctgtatctgcaaatgaacagcctgcgtgccgaggacaccgcggcatattactgtgcgcaaaatctggttaggctggggaggtctaggtgggtgtttgactactggggtcagggaaccctggtcaccgtctcgagc

SEQ ID NO: 769 - DNA, 369 bp, Artificial Sequence
  Description of Artificial Sequence: Synthetic polynucleotide ABT2-65-502
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcggtttcggctatgggtaatcggacatactacgcagactccgtgaagggccggttcaccatttcccgcgacggttccaagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 770 - DNA, 369 bp, Artificial Sequence
  Description of Artificial Sequence: Synthetic polynucleotide ABT2-65-503
gaggtgcagctgttggagtctgggggaggcttggtacagcctggggggtccctgcgtctctcctgtgtagcctccggattcacctttgaggattatcagatggggtgggtccgccaggctccagggaagggtctagagcgggtctcatcggtttcggctatgggtaatcggacacactacgcagactccgtgaagggccggttcaccatctcccgcgacgattccaagaacacgctgtatctgcaaatgaacagcctgcgtgccggggacaccgcggtatattactgtgcgcaaaatctggttaggctggggaggtctaggtggatgtttgactactggggtcagggaaccctggtcaccgtctcgagc

SEQ ID NO: 771 - DNA, 369 bp, Artificial Sequence; identical to SEQ ID NO: 770
  Description of Artificial Sequence: Synthetic polynucleotide ABT2-65-504

SEQ ID NO: 772 - DNA, 369 bp, Artificial Sequence
  Description of Artificial Sequence: Synthetic polynucleotide ABT2-65-505
gaggtgcagctgttggagtctgggggaggcttggtacagcctggggggtccctgcgtctctcctgtgtagcctccggattcacctttgaggattatcggatggggtgggtccgccaggctccagggaagggtctagagtgggtctcatcggtttcggctatgggtaatcggacatactacgcagactccgtgaagggccggttcaccatctcccgcgacggttccaagaacacgctgtatctgcaaatgaacagcctgcgtgccgaggacaccgcggtatattactgtgcgcaaaatctggttaagctggggaggtctaggtggatgtttgactactggggtcagggaaccctggtcaccgtctcgagc

SEQ ID NO: 773 - DNA, 369 bp, Artificial Sequence
  Description of Artificial Sequence: Synthetic polynucleotide ABT2-65-506
gaggtgcagctgttggagtctgggggaggcttggtacggcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattgctgtgcgcaaaatctggttaggctggggaggtctaggtggatgtttgactactggggtcagggaaccctggtcaccgtctcaagc

SEQ ID NO: 774 - DNA, 369 bp, Artificial Sequence
  Description of Artificial Sequence: Synthetic polynucleotide ABT2-65-507
gaggtgcagctgttggagtctgggggaggcttggtacagcctggggggtccctgcgtctcccctgtgtagcctccggattcacctttgaggattgtcagatggggtgggtccgccaggctccagggaagggtctagagtgggtctcatcgatttcggctatgggtaatcggacatactacgcagactccgtgaagggccggttcaccatttcccgcgacaattccaagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 775 - DNA, 369 bp, Artificial Sequence
  Description of Artificial Sequence: Synthetic polynucleotide ABT2-65-508
gaggtgcagctgttggagtctgggggaggcttggtacagcctggggggtccctgcgtctctcctgtgtagcctccggattcccctttgaggattatcagatggggtgggtccgccaggctccaggggagggtctagagtgggcctcatcgatttcggctatgggtaatcggacatactacgcagactccgtgaagggccggttcaccatctcccgcaacgattccaagaacacgctgtatctgcaaatgaacagcctgcgtgccgaggacaccgcggtatattactgtgcgcaaaatctggttaggctgggggggtctaggtggatgtttgactactggggtcagggaaccctggtcaccgtctcgagc

SEQ ID NO: 776 - DNA, 369 bp, Artificial Sequence
  Description of Artificial Sequence: Synthetic polynucleotide ABT2-65-509
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacgccgcggtatattactgtgcgcaaaatctggttaggctggggaggtctaggtggatgtttgactactggggtcagggaaccctggtcaccgtctctagc

SEQ ID NO: 777 - DNA, 369 bp, Artificial Sequence
  Description of Artificial Sequence: Synthetic polynucleotide ABT2-65-510
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccgagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 778 - DNA, 369 bp, Artificial Sequence
  Description of Artificial Sequence: Synthetic polynucleotide ABT2-65-511
gaggtgcagctgttggagtctgggggaggcttggtacagcctggggggtccctgcgtccctcctgtgtagcctccggattcacctttggggattatcagatggggtgggtccgccaggctccagggaagggtctagagtgggtctcatcgatttcggctatgggtagtcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgaccactggggtcagggaaccctggtcaccgtctcgagc

SEQ ID NO: 779 - DNA, 369 bp, Artificial Sequence
  Description of Artificial Sequence: Synthetic polynucleotide ABT2-65-512
gaggtgcagctgttggagtctgggggaggcttggtacagcctggggggtccctgcgtctctcctgtgtagcctccggattcacctttgaggattatcagatggggtgggtccaccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 780 - DNA, 369 bp, Artificial Sequence
  Description of Artificial Sequence: Synthetic polynucleotide ABT2-65-513
gaggtgcagctgttggagtctgggggaggcttggtacagcctggggggtccctgcgtctctcctgtgtagcctccggattcacctttgaggattatcagatggggtgggtccgccaggctccagggaagggtctagagtgggtctcatcgatttcggctgtgggtaatcggacatactacgcagactccgtgaagggccggttcaccatctcccgcgacgattccaagaacacgctgtatctgcaaatgaacagcctgcgtgccgaggacaccgcggtatattactgtgcgcagaatctggttaggctggggaggtctaggcggatgtttgactactggggtcagggaaccctggtcaccgtctcgagc

SEQ ID NO: 781 - DNA, 369 bp, Artificial Sequence
  Description of Artificial Sequence: Synthetic polynucleotide ABT2-65-514
gaggtgcagctgttggagtctggggggggcttggtacagcctggggggtccctgcgtctctcctgtgtagcctccggattcacctttgaggattatcaaatggggtgggcccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 782 - DNA, 369 bp, Artificial Sequence
  Description of Artificial Sequence: Synthetic polynucleotide ABT2-65-515
gagtgcagctgttggaggtctgggggaggcttggtacagcctggggggtccctgcgtctctcctgtgtagcctccggattcacctttgaggattatcagatggggtgggtccgccaggctccagggaagggtctagagtgggtctcatcgatttcggctatgggtaatcggacatactacgcagactccgtgaagggccggttcaccatctcccgcgacgattccaagaacacgctgtatctgcaaatgaacagcctgcgtgccgaggacaccgcggtatattactgtgcgcaaaatctggttaggctggggaggtctaggtggatgtttgactactggggtcagggaaccctggtcaccgtctcgagc

SEQ ID NO: 783 - DNA, 357 bp, Artificial Sequence
  Description of Artificial Sequence: Synthetic polynucleotide ABT2-66
gaggtgcagctgttggagtctgggggaggcttggtacagcctggggggtccctgcgtctctcctgtgcagcctccggattcaccttttctcattatactatggcgtgggtccgccaggctccagggaagggtctagagtgggtctcaactattggttcttctggtaatagtacatactacgcagactccgtgaagggccggttcaccatctcccgcgacaattccaagaacacgctgtatctgcaaatgaacagcctgcgtgccgaggacaccgcggtatattactgtgcgcaaatgcgggggccgtattatacttttgactaccggggtcagggaaccctggtcaccgtctcgagc

SEQ ID NO: 784 - DNA, 351 bp, Artificial Sequence
  Description of Artificial Sequence: Synthetic polynucleotide ABT2-69
gaggtgcagctgttggagtctgggggaggcttggtacagcctggggggtccctgcgtctctcctgtgcagcctccggattcacctttacgggttatgatatggcttgggtccgccaggctccagggaagggtctagagtgggtctcagtgatttatgcttatggtgagtctacatactacgcagactccgtgaagggccggttcaccatctcccgcgacaattccaagaacacgctgtatctgcaaatgaacagcctgcgtgccgaggataccgcggtatattactgtgcgaaagtgtattcgaatcagtttgactactggggtcagggaaccctggtcaccgtctcgagc

SEQ ID NO: 785 - DNA, 354 bp, Artificial Sequence
  Description of Artificial Sequence: Synthetic polynucleotide ABT2-70
gaggtgcagctgttggagtctgggggaggcttggtacagcctggggggtccctgcgtctctcctgtgcagcctcgggattcacctttagggcttatgatatggggtgggtccgccaggctccagggaggggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaacgtctcctaatgcgagttttgactactggggtcagggaaccctggtcaccgtctcgagc

SEQ ID NO: 786 - DNA, 351 bp, Artificial Sequence
  Description of Artificial Sequence: Synthetic polynucleotide ABT2-71
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaaggggtcgtcagtcgtttgactactggggtcagggaaccctggtcaccgtctcgagc

SEQ ID NO: 787 - DNA, 351 bp, Artificial Sequence
  Description of Artificial Sequence: Synthetic polynucleotide ABT2-72
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgcgaaaacttcttctgatgggtttgactactggggtcagggaaccctggtcaccgtctcgagc

SEQ ID NO: 788 - DNA, 360 bp, Artificial Sequence
  Description of Artificial Sequence: Synthetic polynucleotide ABT2-73
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtttattactgtgcgaaattttctccgcttagggctcctgtgtttgactactggggtcagggaaccctggtcaccgtctcgagc

SEQ ID NO: 789 - DNA, 357 bp, Artificial Sequence
  Description of Artificial Sequence: Synthetic polynucleotide ABT2-74
gaggtgcagctgttggagtctgggggaggcttggtacagcctggggggtccctgcgtctctcctgtgcagcctccggattcacctttgatctgtatgatatgcattgggtccgccaggctccagggaagggtctagagtgggtctcaacgatttatgcttatggttatgcgacatactacgcagactccgtgaagggccggttcaccatctcccgcgacaattccaagaacacgctgtatctgcaaatgaacagcctgcgtgccgaggataccgcggtatattactgtgcgaaaaagcatggtatgtatgatcattttgactactggggtcagggaaccctggtcaccgtctcgagc

SEQ ID NO: 790 - DNA, 369 bp, Artificial Sequence
  Description of Artificial Sequence: Synthetic polynucleotide ABT2-75
gaggtgcagctgttggagtctgggggaggcttggtacagcctggggggtccctgcgtctctcctgtgcagcctccggattcacctttgggcagtatccgatggcgtgggtccgccaggctccagggaagggtctagagtgggtctcaactatttctccgaagggtgatcgtacatactacgcagactccgtgaagggccggttcaccatctcccgcgacaattccaagaacacgctgtatctgcaaatgaacagcctgcgtgccgaggacaccgcggtatattactgtgcgaaagcgatgtattcgtatcagtataaggagaagggttttgactactggggtcagggaaccctggtcaccgtctcgagc

SEQ ID NO: 791 - DNA, 351 bp, Artificial Sequence
  Description of Artificial Sequence: Synthetic polynucleotide ABT2-99
gaggtgcagctgttggagtctgggggaggcttggtacagcctggggggtccctgcgtctctcctgtacagcctccggattcacctttcgtgattatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggataccgcggtatattactgtgcgaaaacttcgtctgttaattttgactactggggtcagggaaccctggtcaccgtctcgagc

SEQ ID NO: 792 - DNA, 351 bp, Artificial Sequence
  Description of Artificial Sequence: Synthetic polynucleotide ABT2-101
gaggtgcagctgttggagtctgggggaggcttggtacagcctggggggtccctgcgtctctcctgtgcagcctccggattcacctttagggcttatgatatggggtgggtccgccaggctccagggaagggtctagagtgggtctcagttatttatgcgtggggtactagtacatactacgcagactccgtgaagggccggttcaccatctcccgcgacaattccaagaacacgctgtatctgcaaatgaacagcctgcgtgccgaggacaccgcggtatattactgtgtgaaacggggggagggtaagtttgactactggggtcagggaaccctggtcaccgtctcgagc

SEQ ID NO: 793 - DNA, 354 bp, Artificial Sequence
  Description of Artificial Sequence: Synthetic polynucleotide ABT2-104
gaggtgcagctgttggagtctgggggaggcttggtacagcctggagggtccctgcgtctctcctgtgcagcctccggattcacctttagggcgtatcggatgggttgggtccgccaggctccagggaagggtctagagtgggtctcatggatttggcctaatggttctcatgcatactacgcagactccgtgaagggccggttcaccatctcccgcgacaattccaagaacacgctgtatctgcaaatgaacagcctgcgtgccgaggacaccgcggtatattactgtgcgcaatttcgtgataatcagcggtttgactaccggggtcagggaaccctggtcaccgtctcgagc

SEQ ID NO: 794 - DNA, 354 bp, Artificial Sequence
  Description of Artificial Sequence: Synthetic polynucleotide ABT2-105
gaggtgcagctgttggagtctgggggaggcttggtacagcctggggggtccctgcgtctctcctgtgcagcctccggattcaccttttttgcttatgagatgtcgtgggtccgccaggctccagggaagggtctagagtgggtctcatctatttcttataatggtactcagacatactacgcagactccgtgaagggccggttcaccatctcccgcgacaattccaagaacacgctgtatctgcaaatgaacagcctgcgtgccgaggataccgcggtatattactgtgcgaaaaggccggatctttcgagttttgactactggggtcagggaaccctggtcaccgtctcgagc

SEQ ID NO: 795 - DNA, 351 bp, Artificial Sequence
  Description of Artificial Sequence: Synthetic polynucleotide ABT2-106
gaggtgcagctgttggagtctgggggaggcttggtacagcctggggggtccctgcgtctctcctgtgcagcctccggattcacctttagtgattatgggatgagttgggtccgccaggctccagggaagggtctagagtgggtctcagctattgctactgatggcgtgtctacatactacgcagactccgtgaagggccggttcaccatctcccgcgacaattccaagaacacgctgtatctgcaaatgaacagcctgcgtgccgaggacaccgcggtatattactgtgcgaaatatttttatccgaattttgactactggggtcagggaaccctggtcaccgtctcgagc

SEQ ID NO: 796 - DNA, 354 bp, Artificial Sequence
  Description of Artificial Sequence: Synthetic polynucleotide ABT2-107
gaggtgcagctgttggagtctgggggaggcttggtacagcctggggggtccctgcgtctctcctgtgcagcctccggattcacctttccgccttatgcgatgggttgggtccgccaggctccagggaagggtctggagtgggtctcattgatttatgagaatggttttaatacatactacgcagactccgtgaagggccggttcaccatctcccgcgacaattccaagaacacgctgtatctgcaaatgaacagcctgcgtgccgaggacaccgcggtatattactgtgcgaaaactttgggttctaatttgtttgactactggggtcagggaaccctggtcaccgtctcgagc

SEQ ID NO: 797 - DNA, 366 bp, Artificial Sequence
  Description of Artificial Sequence: Synthetic polynucleotide ABT2-108
gaggtgcagctgttggagtctgggggaggcttggtacagcctggggggtccctgcgtctctcctgtgcagcctccggattcacctttgctgagtatactatgatgtgggtccgccaggctccagggaagggtctcgagtgggtctcacgtattgggcaggatggtaagaatacatactacgcagactccgtgaagggccggttcaccatctcccgcgacaattccaagaacacgctgtatctgcaaatgaacagcctgcgtgccgaggacaccgcggtatattactgtgcgaaatatacgggtcgggttggtgttcatcatctttttgactactggggtcagggaaccctggtcaccgtctcgagc

SEQ ID NO: 798 - DNA, 366 bp, Artificial Sequence
  Description of Artificial Sequence: Synthetic polynucleotide ABT2-108-533X
gaggtgcagctgttggagtctgggggaggcttggtacagcctggggggtccctgcgtctctcctgtgcagcctccggattcacctttgctgacgaggggatgatgtgggtccgccaggctccagggaaaggtctcgagtgggtctcacgtattgggcaggatggtaagaatacatactacgcagactccgtgaagggccggttcaccatctcccgcgacaattccaagaacacgctgtatctgcaaatgaacagcctgcgtgccgaggacaccgcggtatattactgtgcgaaatatacgggtcggatcctcgggcatcatctttttgactactggggtcagggaaccctggtcaccgtctcgagc

SEQ ID NO: 799 - DNA, 366 bp, Artificial Sequence
  Description of Artificial Sequence: Synthetic polynucleotide ABT2-108-534X
gaggtgcagctgttggagtctgggggaggcttggtacagcctggggggtccctgcgtctctcctgtgcagcctccggattcacctttgctgacgaggggatgatgtgggtccgccaggctccagggaaaggtctcgagtgggtctcacgtattacctacagcggtaagaatacatactacgcagactccgtgaagggccggttcaccatctcccgcgacaattccaagaacacgctgtatctgcaaatgaacagcctgcgtgccgaggacaccgcggtatattactgtgcgaaatatacgggtcggatcttctcccatcatctttttgactactggggtcagggaaccctggtcaccgtctcgagc

SEQ ID NO: 800 - DNA, 366 bp, Artificial Sequence
  Description of Artificial Sequence: Synthetic polynucleotide ABT2-108-537X
gaggtgcagctgttggagtctgggggaggcttggtacagcctggggggtccctgcgtctctcctgtgcagcctccggattcacctttgctgacgaggggatgatgtgggtccgccaggctccagggaagggtctcgagtgggtctcacgtattgggcaggatggtaagaatacatactaccggatggacgtgaagggccggttcaccatctcccgcgacaattccaagaacacgctgtatctgcaaatgaacagcctgcgtgccgaggacaccgcggtatattactgtgcgaaatatacgggtcggatcctcgggcatcatctttttgactactggggtcagggaaccctggtcaccgtctcgagc

SEQ ID NO: 801 - DNA, 366 bp, Artificial Sequence
  Description of Artificial Sequence: Synthetic polynucleotide ABT2-108-538X
gaggtgcagctgttggagtctgggggaggcttggtacagcctggggggtccctgcgtctctcctgtgcagcctccggattcacctttgctgacgaggggatgatgtgggtccgccaggctccagggaagggtctcgagtgggtctcacgtattacctacagcggtaagaatacgtactacgcagactccgtgaagggccggttcaccatctcccgcgacaattccaagaacacgctgtatctgcaaatgaacagcctgcgtgccgaggacaccgcggtatattactgtgcgaaatatacgggtcggatcctcgggcatcatctttttgactactggggtcagggaaccctggtcaccgtctcgagc

SEQ ID NO: 802 - DNA, 366 bp, Artificial Sequence
  Description of Artificial Sequence: Synthetic polynucleotide ABT2-108-620X
gaggtgcagctgttggagtctgggggaggcttggtacagcctggggggtccctgcgtctctcctgtgcagcctccggattcacctttgctgaggagtcgtggatgtgggtccgccaggctccagggaagggtctcgagtgggtctcacgtattgggcaggatggtaagaatacatactaccgcgaggacgtgaagggccggttcaccatctcccgcgacaattccaagaacacgctatatctgcaaatgaacagcctgcgtgccgaggacaccgcggtatattactgtgcgaaatatacgggtcggatcatgggccatcatctttttgactactggggtcagggaaccctggtcaccgtctcgagc

SEQ ID NO: 803 - DNA, 324 bp, Artificial Sequence
  Description of Artificial Sequence: Synthetic polynucleotide ABT2 VK dAbs:ABT2-6
gacatccagatgacccagtctccatcctccctgtctgcatctgtaggagaccgtgtcaccatcacttgccgggcaagtcagagcattgggctactgttaacttggtaccagcagaaaccagggaaagcccctaagctcctgatctatatggcatcccagttgcaaagtggggtcccatcacgtttcagcggcagtggatctgggacagatttcactctcaccatcagcagtctgcaacctgaagattttgctacgtactactgtcaacagtggcatcgtcctcctagtacgttcggccaagggaccaaggtggaaatcaaacgg

SEQ ID NO: 804 - DNA, 324 bp, Artificial Sequence
  Description of Artificial Sequence: Synthetic polynucleotide ABT2-7
gacatccagatgacccagtctccatcctccctgtctgcatctgtaggagaccgtgtcaccatcacttgccgggcaagtcagagcattaagtctgggttaaattggtaccagcagaaaccagggaaagcccctaagctcctgatctatatggcatcccagttgcaaagtggggtcccatcacgtttcagtggcagtggatctgggacagatttcactctcaccatcagcagtctgcaacctgaagattttgctacgtactactgtcaacagtggcatcgtcctcctagtacgttcggccaagggaccaaggtggaaatcaaacgg

SEQ ID NO: 805 - DNA, 324 bp, Artificial Sequence
  Description of Artificial Sequence: Synthetic polynucleotide ABT2-8
gacatccagatgacccagtctccatcctccctgtctgcatctgtaggagaccgtgtcaccatcacttgccgggcaagtcagagcattaagtctatgttagcttggtaccagcagaaaccagggaaagcccctaagctcctgatctatatggcatccaatttgcaaagtggggtcccatcacgtttcagtggcagtggatctgggacagatttcactctcaccatcagcagtctgcaacctgaagattttgctacgtactactgtcaacagactattgttaagccttctacgttcggccaagggactaaggtggaaatcaaacgg

SEQ ID NO: 806 - DNA, 324 bp, Artificial Sequence
  Description of Artificial Sequence: Synthetic polynucleotide ABT2-42
gacatccagatgacccagtctccatcctccctgtctgcatctgtaggagaccgtgtcaccatcacttgccgggcaagtcagtatattgagaagtggttaacttggtatcagcagaaaccagggaaagcccctacgctcctgatctatcgtgggtccttgttgcaaagtggggtcccatcacgtttcagtggcagtggatctgggacagatttcactctcaccatcagcagtctgcaacctgaagattttgctacgtactactgtcaacagactgagtattggccttttacgttcggccaagggaccaaggtggaaatcaaacgg

SEQ ID NO: 807 - DNA, 324 bp, Artificial Sequence
  Description of Artificial Sequence: Synthetic polynucleotide ABT2-43
gacatccagatgacccagtctccatcctccctgtctgcatctgtaggagaccgtgtcaccatcacttgccgggcaagtcagaatattgatacgtatttaacttggtaccagcagaaaccagggaaagcccctaggctcctgatctatggggcttccacgttgcaaagtggggtcccatcacgtttcagtggcagtggatctgggacagatttcactctcaccatcagcagtctgcaacctgaagattttgctacgtactactgtcaacagcgtgcttattatcctacgacgttcggccaagggaccaaggtggaaatcaaacgg

SEQ ID NO: 808 - DNA, 324 bp, Artificial Sequence
  Description of Artificial Sequence: Synthetic polynucleotide ABT2-44
gacatccagatgacccagtctccatcctccctgtctgcatctgtaggagaccgtgtcaccatcacttgccgggcaagtcaggatattggtgagtggttagagtggtatcagcagaaaccagggaaagcccctaagctcctgatctatcgggcgtccactttgcaaagtggggtcccatcacgtttcagtggcagtggatctgggacagatttcactctcaccatcagcagtctgcaacctgaagattttgctacgtactactgtcaacagcatgcgtattatccttttacgttcggccaagggaccaaggtggaaatcaaacgg

SEQ ID NO: 809 - DNA, 324 bp, Artificial Sequence
  Description of Artificial Sequence: Synthetic polynucleotide ABT2-46
gacatccagatgacccagtctccatcctccctgtctgcatctgtaggagaccgtgtcaccatcacttgccgggcaagtcagagtattattgagtggttaagttggtaccagcagaaaccagggaaagcccctaagctcctgatctatcgtacttccgtgttgcaaagtggggtcccatcacgtttcagtggcagtggatctgggacagatttcactctcaccatcagcagtctgcaacctgaagattttgctacgtactactgtcaacagaatgagttttggccttttacgttcggccaagggaccaaggtggaaatcaaacgg

SEQ ID NO: 810 - DNA, 324 bp, Artificial Sequence
  Description of Artificial Sequence: Synthetic polynucleotide ABT2-53
gacatccagatgacccagtctccatcctccctgtctgcatctgtaggagaccgtgtcaccatcacttgccgggcaagtcagagcattaagaagcatttagcgtggtaccagcagaaaccagggaaagcccctaagctcctgatctataatgcatccaagttgcaaagtggggtcccatcacgtttcagtggcagtggatctgggacagatttcactctcaccatcagcagtctgcaacctgaagattttgctacgtactactgtcaacagactaagcgggagcctaagacgtttggccaagggaccaaggtggaaatcaaacgg

SEQ ID NO: 811 - DNA, 324 bp, Artificial Sequence; identical to SEQ ID NO: 804
  Description of Artificial Sequence: Synthetic polynucleotide ABT2-54

SEQ ID NO: 812 - DNA, 324 bp, Artificial Sequence
  Description of Artificial Sequence: Synthetic polynucleotide ABT2-55
gacatccagatgacccagtctccatcctccctgtctgcatctgtaggagaccgtgtcaccatcacttgccgggcaagtcagagcattaagactaggttaaattggtaccagcagaaaccagggaaagcccctaagctcctgatctatctggcatcccgtttgcaaagtggggtcccatcacgtttcagtggcagtggatctgggacagatttcactctcaccatcagcagtctgcaacctgaagattttgctacgtactactgtcaacaggtgtggcgtcttcctagtacgttcggccaagggaccaaggtggaaatcaaacgg

SEQ ID NO: 813 - DNA, 324 bp, Artificial Sequence
  Description of Artificial Sequence: Synthetic polynucleotide ABT2-56
gacatccagatgacccagtctccatcctccctgtctgcatctgtaggagaccgtgtcaccatcacctgccgggcaagtcagagcattgggaggcggttaagttggtaccagcagaaaccagggaaagcccctaagctcctgatctataaggcatcccgtttgcaaagtggggtcccatcacgtttcagtggcagtggatctgggacagatttcactctcaccatcagcagtctgcaacctgaagattttgctacgtactactgtcaacagcgtgttagtgttcctcggacgttcggccaagggaccaaggtggaaatcaaacgg

SEQ ID NO: 814 - DNA, 324 bp, Artificial Sequence
  Description of Artificial Sequence: Synthetic polynucleotide ABT2-57
gacatccagatgacccagtctccatcctccctgtctgcatctgtaggagaccgtgtcaccatcacttgccgggcaagtcagagcattgcgcgtcagttagcgtggtaccagcagaaaccagggaaagcccctaagctcctgatctataaggcatcccggttgcaaagtggggtcccatcacgtttcagtggcagtggatctgggacagatttcactctcaccatcagcagtctgcaacctgaagattttgctacgtactactgtcaacagtatcggatgcggcctaagacgttcggccaagggaccaaggtggaaatcaaacgg

SEQ ID NO: 815 - DNA, 324 bp, Artificial Sequence
  Description of Artificial Sequence: Synthetic polynucleotide ABT2-58
gacatccagatgacccagtctccatcctccctgtctgcatctgtaggagaccgtgtcaccatcacttgccgggcaagtcagagcatttctaagaagttagattggtaccagcagaaaccagggaaagcccctaagctcctgatctattcggcatcccatttgcaaagtggggtcccatcacgtttcagtggcagtggatctgggacagatttcactctcaccatcagcagtctgcaacctgaagattttgctacgtactactgtcaacagaggcggcgtaagcctactacgttcggccaagggaccaaggtggaaatcaaacgg

SEQ ID NO: 816 - DNA, 324 bp, Artificial Sequence
  Description of Artificial Sequence: Synthetic polynucleotide ABT2-59
gacatccagatgacccagtctccatcctccctgtctgcatctgtaggagaccgtgtcaccatcacttgccgggctagtcagagcattaatgtatttttatcgtggtaccagcagaaaccagggaaagcccctaagctcctgatctataatgcatccaatttgcaaagtggggtcccatcacgtttcagtggcagtggatctgggacagatttcactctcaccatcagcagtctgcaacctgaagattttgctacgtactactgtcaacagcgggctctttatcctactacgttcggccaagggaccaaggtggaaatcaaacgg

SEQ ID NO: 817 - DNA, 324 bp, Artificial Sequence
  Description of Artificial Sequence: Synthetic polynucleotide ABT2-60
gacatccagatgacccagtctccatcctccctgtctgcatctgtaggagaccgtgtcaccatcacttgccgggcaagtcagagcattagggtttttttatcttggtaccagcagaaaccagggaaagcccctaagctcctgatctataatgcatccaatttgcaaagtggggtcccatcacgtttcagtggcagtggatctgggacagatttcactctcaccatcagcagtctgcaacctgaagattttgctacgtactactgtcaacagcgggctctttatcctactacgttcggccaagggaccaaggtggaaatcaaacgg

SEQ ID NO: 818 - DNA, 324 bp, Artificial Sequence
  Description of Artificial Sequence: Synthetic polynucleotide ABT2-61
gacatccagatgacccagtctccatcctccctgtctgcatctgtaggagaccgtgtcaccatcacttgccgggcaagtcagagcattagggtttttttatcttggtatcagcagaaaccagggaaagcccctaagctcctgatctataacgcatcccatttgcaaagtggggtcccatcacgtttcagtggcagtggatctgggacagatttcactctcaccatcagcagtctgcaacctgaagattttgctacgtactactgtcaacagcgggctctttatcctactacgttcggccaagggaccaaggtggaaatcaaacgg

SEQ ID NO: 819 - DNA, 324 bp, Artificial Sequence
  Description of Artificial Sequence: Synthetic polynucleotide ABT2-62
gacatccagatgacccagtctccatcctccctgtctgcatctgtaggagaccgtgtcaccatcacttgccgggcaagtcagagcattcagacttatttaagttggtatcagcagaaaccagggaaagcccctaagctcctgatctataatgcatccaatttgcaaagtggggtcccatcacgtttcagtggcagtggatctgggacagatttcactctcaccatcagcagtctgcaacctgaagattttgctacgtactactgtcaacagcgggctctttatcctactacgttcggccaagggaccaaggtggaaatcaaacgg

SEQ ID NO: 820 - DNA, 324 bp, Artificial Sequence
  Description of Artificial Sequence: Synthetic polynucleotide ABT2-63
gacatccagatgacccagtctccatcctccctgtctgcatctgtaggagaccgtgtcaccatcacttgccgggcaagtcagagcattagggtttttttatcttggtatcagcagaaaccagggaaagcccctaagctcctgatctataatgcatcctatttgcaaagtggggtcccatcacgtttcagtggcagtggatctgggacagatttcactctcaccatcagcagtctgcaacctgaagattttgctacgtactactgtcaacagcgggctctttatcctactacgttcggccaagggaccaaggtggaaatcaaacgg

SEQ ID NO: 821 - DNA, 324 bp, Artificial Sequence
  Description of Artificial Sequence: Synthetic polynucleotide ABT2-67
gacatccagatgacccagtctccatcctccctgtctgcatctgtaggagaccgagtcaccatcacttgccgggcaagtcagtatattggggagcatttagcttggtaccagcagaaaccggggaaagcccctaagctcctgatctatcataattccgctttgcaaagtggggtcccatcacgtttcagtggcagtggatctgggacagatttcactctcaccatcagcagtctgcaacctgaagattttgctacgtactactgtcaacagcatgcgtttcttcctaatacgttcggccaagggaccaaggtggaaatcaaacgg

SEQ ID NO: 822 - DNA, 324 bp, Artificial Sequence
  Description of Artificial Sequence: Synthetic polynucleotide ABT2-68
gacatccagatgacccagtctccatcctccctgtctgcatctgtaggagaccgtgtcaccatcacttgccgggcaagtcagaatatttggtatcatttaaattggtaccagcagaaaccagggaaagcccctaagctcctgatctatcttggttcccggttgcaaagtggggtcccatcacgtttcagtggcagtggatctgggacagatttcactctcaccatcagcagtctgcaacctgaagatttcgctacgtactactgtcaacagattcatcatgatccttttacgttcggccaagggaccaaggtggaaatcaaacgg

SEQ ID NO: 823 - DNA, 324 bp, Artificial Sequence
  Description of Artificial Sequence: Synthetic polynucleotide ABT2-76
gacatccagatgacccagtctccatcctccctgtctgcatctgtaggagaccgtgtcaccatcacttgccgggcaagtcagtcgattgatcggtggttagcgtggtatcagcagaaaccagggaaagcccctaagctcctgatctatcggggttccattttgcaaagtggggtcccatcacgtttcagtggcagtggatctgggacagatttcactctcaccatcagcagtctgcaacctgaagattttgctacgtactactgtcaacaggttgcgttttggcctcctacgttcggccaagggaccaaggtggaaatcaaacgg

SEQ ID NO: 824 - DNA, 324 bp, Artificial Sequence
  Description of Artificial Sequence: Synthetic polynucleotide ABT2-77
gacatccagatgacccagtctccatcctccctgtctgcatctgtaggagaccgtgtcaccatcacttgccgggcaagtcagaatattggggcgcatttaaagtggtatcagcagaaaccagggaaagcccctaagctcctgatctatcgtacttcccggttgcaaagtggggtcccatcacgtttcagtggcagtggatctgggacagattttactctcaccatcagcagtctgcaacctgaagattttgctacgtactactgtcaacagaatcatactcgtcctcatacgttcggccaagggaccaaggtggaaatcaaacgg

SEQ ID NO: 825 - DNA, 324 bp, Artificial Sequence
  Description of Artificial Sequence: Synthetic polynucleotide ABT2-79
gacatccagatgacccagtctccatcctccctgtctgcatctgtaggagaccgtgtcaccatcacttgccgggcaagtcagcagattggtgagtggttaaattggtatcagcagaaaccagggaaagcccctaagctcctgatctatcggacgtccctgttgcaaagtggggtcccatcacgtttcagtggcagtggatctgggacagatttcactctcaccatcagcagtctgcaacctgaagattttgctacgtactactgtcaacagactaatttttggcctcctacgttcggccaagggaccaaggtggaaatcaaacgg

SEQ ID NO: 826 - DNA, 324 bp, Artificial Sequence
  Description of Artificial Sequence: Synthetic polynucleotide ABT2-80
gacatccagatgacccagtctccatcctccctgtctgcatctgtaggagaccgtgtcaccatcacttgccgggcaagtcaggctatttatcataatttaaagtggtaccagcagaaaccagggaaggcccctaagctcctgatctatcatacgtcctatttgcaaagtggggtcccatcacgtttcagtggcagtggatctgggacagatttcactctcaccatcagcagtctgcaacctgaagattttgctacgtactactgtcaacagacgtgggcttatccttatacgttcggccaagggaccaaggtggaaatcaaacgg

SEQ ID NO: 827 - DNA, 324 bp, Artificial Sequence; identical to SEQ ID NO: 418
  Description of Artificial Sequence: Synthetic polynucleotide ABT2-81

SEQ ID NO: 828 - DNA, 324 bp, Artificial Sequence
  Description of Artificial Sequence: Synthetic polynucleotide ABT2-83
gacatccagatgacccagtctccatcctccctgtctgcatctgtaggagaccgtgtcaccatcacttgccgggcaagtcagcctattcagactaagttagcgtggtatcagcagaaaccagggaaagcccctaagctcctgatctatcataattccattttgcaaagtggggtcccatcacgtttcagtggcagtggatctgggacagatttcactctcaccatcagcagtctgcaacctgaagattttgctacgtactactgtcaacagtttcgtaagcatccttttacgttcggccaagggaccaaggtggaaatcaaacgg

SEQ ID NO: 829 - DNA, 324 bp, Artificial Sequence
  Description of Artificial Sequence: Synthetic polynucleotide ABT2-84
gacatccagatgacccagtctccatcctccctgtctgcatctgtaggagaccgtgtcaccatcacttgccgggcaagtcagattattgatacgtggttaaattggtatcagcagaaaccagggaaagcccttaagctcctgatctatcgtacttcctctttgcaaagtggggtcccatcacgtttcagtggcagtggatctgggacagatttcactctcaccatcagcagtctgcaacctgaagattttgctacgtactactgtcaacagagtaattattggcctgctacgtttggccaagggaccaaggtggaaatcaaacgg

SEQ ID NO: 830 - DNA, 324 bp, Artificial Sequence
  Description of Artificial Sequence: Synthetic polynucleotide ABT2-85
gacatccagatgacccagtctccatcctccctgtctgcatctgtaggagaccgtgtcaccatcacttgccgggcaagtcagaggattcgtaagcgtttaaagtggtatcagcagaaaccagggaaagcccctaagctcctgatctattcgtcgtccaagttgcaaagtggggtcccatcacgtttcagcggcagtggatctgggacagatttcactctcaccatcagcagtctgcaacctgaagattttgctacgtactactgtcaacagaatttttctaagccttcgacgttcggccaagggaccaaggtggaaatcaaacgg

SEQ ID NO: 831 - DNA, 324 bp, Artificial Sequence
  Description of Artificial Sequence: Synthetic polynucleotide ABT2-86
gacatccagatgacccagtctccatcctccctgtctgcatctgtaggagaccgtgtcaccatcacttgccgggcaagtcagagtattaagaagtatttagcttggtatcagcagaaaccagggaaagcccctaagctcctgatctatctggcttccacgttgcaaagtggggtcccatcacgtttcagtggcagtggatctgggacagatttcactctcaccattagcagtctgcaacctgaagatttcgctacgtactactgtcaacagacgctgacgtatccttctacgttcggccaagggactaaggtggaaatcaaacgg

SEQ ID NO: 832 - DNA, 324 bp, Artificial Sequence
  Description of Artificial Sequence: Synthetic polynucleotide ABT2-87
gacatccagatgacccagtctccatcctccctgtctgcatctgtaggagaccgtgtcaccatcacttgccgggcaagtcagtcgattagtgtttatttatcttggtatcagcagaaaccagggaaagcccctaagctcctgatctataatgcttccattttgcaaagtggggtcccatcacgtttcagtggcagtggatctgggacagatttcactctcaccatcagcagtctgcaacctgaagattttgctacgtactactgtcaacagagggctcattatcctactacgttcggccaagggaccaaggtggaaatcaaacgg

SEQ ID NO: 833 - DNA, 324 bp, Artificial Sequence
  Description of Artificial Sequence: Synthetic polynucleotide ABT2-88
gacatccagatgacccagtctccatcctccctgtctgcatctgtaggagaccgtgtcaccatcacttgccgggcaagtcagtctattgatgagtggttagagtggtaccagcagaaaccagggaaagcccctaagctcctgatctatcgtgcgtcccgtttgcaaagtggggtcccatcacgtttcagtggcagtggatctgggacagatttcactctcaccatcagcaatctgcaacctgaagattttgctacgtactactgtcaacaggcggcttcgtggcctcgtacgttcggccaagggaccaaggtggaaatcaaacgg

SEQ ID NO: 834 - DNA, 324 bp, Artificial Sequence; identical to SEQ ID NO: 823
  Description of Artificial Sequence: Synthetic polynucleotide ABT2-89

SEQ ID NO: 835 - DNA, 324 bp, Artificial Sequence
  Description of Artificial Sequence: Synthetic polynucleotide ABT2-90
gacatccagatgactcagtctccatcctccctgtctgcatctgtaggagaccgtgtcaccatcacttgccgggcaagtcagaatattgatcagtggttagcgtggtaccagcagaaaccagggaaagcccctaagctcctgatctatcggacgtcccgtttgcaaagtggggtcccatcacgtttcagtggcagtggatccgggacagatttcactctcaccatcagcagtctgcaacctgaagatttcgctacgtactactgtcaacaggttgctgcgtttcctgctacgttcggccaagggaccaaggtggaaatcaaacgg

SEQ ID NO: 836 - DNA, 324 bp, Artificial Sequence
  Description of Artificial Sequence: Synthetic polynucleotide ABT2-91
gacatccagatgacccagtctccatcctccctgtctgcatctgtaggagaccgtgtcaccatcacttgccgggcaagtcagcttattgggaagcatttaaattggtatcagcagaaaccagggaaagcccctaagctcctgatctatcatgagtccgctttgcaaagtggggtcccatcacgtttcagtggcagtggatctgggacagatttcactctcaccatcagcagtctgcaacctgaagattttgctacgtactactgtcaacagcatgcgttttctcctcatacgttcggccaagggaccaaggtggaaatcaaacgg

SEQ ID NO: 837 - DNA, 324 bp, Artificial Sequence
  Description of Artificial Sequence: Synthetic polynucleotide ABT2-93
gacatccagatgacccaggctccatcctccctgtctgcatcagtaggagaccgtgtcaccatcacttgccgggcaagtcagtcgattggtccgcatttaaattggtaccagcagaaaccagggaaagcccctaagctcctgatctatcatatttccactttgcaaagtggggtcccatcacgtttcagtggcagtggatctgggacagatttcactctcaccatcagcagtccgcaacctgaagattttgctacgtactactgtcagcagcatgcgttttctcctcatacgttcggccaagggaccaaggtggaaatcaaacgg

SEQ ID NO: 838 - DNA, 324 bp, Artificial Sequence
  Description of Artificial Sequence: Synthetic polynucleotide ABT2-94
gacatccagatgacccagtctccatcctccctgtctgcatctgtaggagaccgtgtcaccatcacttgccgggcaagtcaggcgattggtattcatttagattggtaccagcagaaaccagggaaagcccctaagctcctgatctatgatacttcctctttgcaaagtggggtcccatcacgtttcagtggcagtggatctgggacagatttcactctcaccatcagcagtctgcaacctgaagattttgctacgtactactgtcaacagcatgcgcttttgcctcatacgttcggccaagggaccaaggtggaaatcaaacgg

SEQ ID NO: 839 - DNA, 324 bp, Artificial Sequence
  Description of Artificial Sequence: Synthetic polynucleotide ABT2-95
gacatccagatgacccagtctccatcctccctgtctgcatctgtaggagaccgtgtcaccatcacttgccgggcaagtcagtttattggtcattatttagcttggtatcagcagaaaccagggaaagcccctaagctcctgatctatccggcgtccaagttgcaaagtggggtcccatcacgtttcagtggcagtggatctgggacagatttcactctcaccatcagcagtctgcaacctgaagattttgctacgtactactgtcaacagacttatctgaatcctacgacgttcggccaagggaccaaggtggaaatcaaacgg

SEQ ID NO: 840 - DNA, 324 bp, Artificial Sequence
  Description of Artificial Sequence: Synthetic polynucleotide ABT2-96
gacatccagatgacccagtctccatcctccctgtctgcatctgtaggagaccgtgtcaccatcacttgccgggcaagtcagggtattaagaggaagttaaagtggtaccagcagaaaccagggaaagcccctaagctcctgatctatcaggcttcccgtttgcaaagtggggtcccatcacgtttcagtggcagtggatctgggacagatttcactctcaccatcagcagtctgcaacctgaagattttgctacgtactactgtcaacagaatgcgcagcgtccttttacgttcggccaagggaccaaggtggaaatcaaacgg

SEQ ID NO: 841 - DNA, 324 bp, Artificial Sequence
  Description of Artificial Sequence: Synthetic polynucleotide ABT2-97
gacatccagatgacccagtctccatcctccctgtctgcatctgtaggagaccgtgtcaccatcacttgccgggcaagtcagcagattgatcagtggttatcgtggtaccagcagaaaccagggaaagcccctaagctcctgatctatcggacttccttgttgcaaagtggggtcccatcacgtttcagtggcagtggatctgggacagatttcactctcaccatcagcagcctgcaacctgaagattttgctacgtactactgtcaacaggctgagtattggccttttacgttcggccaagggaccaaggtggaaatcaaacgg

SEQ ID NO: 842 - DNA, 324 bp, Artificial Sequence
  Description of Artificial Sequence: Synthetic polynucleotide ABT2-98
gacatccagatgacccagtctccatcctccctgtctgcatctgtaggagaccgtgttaccatcacttgccgggcaagtcagtatattggtaataatttacattggtaccagcagaaaccagggaaagcccctaagctcctgatctataaggggtccaagttgcaaagtggggtcccatcacgtttcagtggcagtggatctgggacagatttcactctcaccatcagcagtctgcaacctgaagatttcgctacgtactactgtcaacagaattctgctcgtcctcatacgttcggccaagggaccaaggtggaaatcaaacgg

SEQ ID NO: 843 - DNA, 351 bp, Artificial Sequence
  Description of Artificial Sequence: Synthetic polynucleotide ABT1-138
gaggtgcagctgttggagtctgggggaggcttggtacagcctggggggtccctgcgtctctcctgtgcagcctccggattcacctttaatgagtatcttatgtattgggtccgccaggctccagggaagggtctggagtgggtctcatctattagtccgcttggttatcatacatactacgcagactccgtgaagggccggttcaccatctcccgcgacaattccaagaacacgctgtatctgcaaatgaacagcctgcgtgccgaggacaccgcggtatattactgtgcgaaacgtgctcggtggtattttgactactggggtcagggaaccctggtcaccgtctcgagc

SEQ ID NO: 844 - DNA, 7360 bp, Artificial Sequence
  Description of Artificial Sequence: Synthetic polynucleotide sequence pBOS-hCg1,z,non-a, mut (234, 235)
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgcggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 845 - DNA, 7360 bp, Artificial Sequence
  Description of Artificial Sequence: Synthetic polynucleotide sequence pBOS-hCg1,z,non-a, mut (234, 237)
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccctgggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 846 - DNA, 7360 bp, Artificial Sequence
  Description of Artificial Sequence: Synthetic polynucleotide sequence pBOS-hCg1,z,non-a
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgcgaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 847 - DNA, 7349 bp, Artificial Sequence
  Description of Artificial Sequence: Synthetic polynucleotide sequence pBOS-hCg2,(n-)
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctgcagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgacgcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 848 - DNA, 7349 bp, Artificial Sequence
  Description of Artificial Sequence: Synthetic polynucleotide sequence pBOS-hCg2,(n+)
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctgcagtcctcaggactctactccctcagcagcgtggtgaccgtgacctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgacgcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 849 - DNA, 7351 bp, Artificial Sequence
  Description of Artificial Sequence: Synthetic polynucleotide sequence pBOS-hCg4
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatccgtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatacggtccgccatgcccatcatgcccagcacctgaattcctggggggaccatcagtcttcctgttccccccaaaacccaaggacaccctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 850 - DNA, 6701 bp, Artificial Sequence
  Description of Artificial Sequence: Synthetic polynucleotide sequence pBOS-hCk
tcaggtgtcgtgaggaattctctagagatccctcgacctcgagatccattgtgcccgggcgcaccatggacatgcgcgtgcccgcccagctgctgggcctgctgctgctgtggttccccggctcgcgatgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagctacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 851 - DNA, 6679 bp, Artificial Sequence
  Description of Artificial Sequence: Synthetic polynucleotide sequence pBOS-hCl
tcaggtgtcgtgaggaattctctagagatccctcgacctcgagatccattgtgcccgggcgccaccatgacttggaccccactcctcttcctcaccctcctcctccactgcacaggaagcttatcgcgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgttaacccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttcatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 852 - DNA, 7342 bp, Artificial Sequence
  Description of Artificial Sequence: Synthetic polynucleotide sequence pBOS-mCg1
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgctaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaataagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 853 - DNA, 7360 bp, Artificial Sequence
  Description of Artificial Sequence: Synthetic polynucleotide sequence pBOS-mCg2a
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgctaaaacaacagccccatcggtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaataagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 854 - DNA, 6696 bp, Artificial Sequence
  Description of Artificial Sequence: Synthetic polynucleotide sequence pBOS-mCk
tcaggtgtcgtgaggaattctctagagatccctcgacctcgagatccattgtgcccgggcgcaccatggacatgcgcgtgcccgcccagctgctgggcctgctgctgctgtggttccccggctcgcgatgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttaagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 855 - DNA, 7360 bp, Artificial Sequence
  Description of Artificial Sequence: Synthetic polynucleotide sequence pBOS-hCg1,z,a-
tcaggtgtcgtgaggaattctctagagatccctcgacctcgagatccattgtgcccgggcgccaccatggagtttgggctgagctggctttttcttgtcgcgattttaaaaggtgtccagtgcgcatggtatgccgaaagggatgctgaaattgagaacgaaaagctgcgccgggaggttgaagaactgcggcaggccagcgaggcagatctccagccaggaactattgagtacgaacgccatcgacttacgcgtgcgcaggccgacgcacaggaactgaagaatgccagagactccgctgaagtggtggaaaccgcattctgtactttcgtgctgtcgcggatcgcaggtgaaattgccagtattctcgacgggctccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgctaattactatctcccgaaagaatccgcataccaggaagggcgctgggaaacactgccctttcagcgggccatcatgaatgcgatgggcagcgactacatccgtgaggtgaatgtggtgaagtctgcccgtgtcggttattccaaaatgctgctgggtgtttatgcctactttatagagcataagcagcgcaacacccttatctggttgccgacggatggtgatgccgagaactttatgaaaacccacgttgagccgactattcgtgatattccgtcgctgctggcgctggccccgtggtatggcaaaaagcaccgggataacacgctcaccatgaagcgtttcactaatgggcgtggcttctggtgcctgggcggtaaagcggcaaaaaactaccgtgaaaagtcggtggatgtggcgggttatgatgaacttgctgcttttgatgatgatattgaacaggaaggctctccgacgttcctgggtgacaagcgcgtcgaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgagcggccgcgactctagagtgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaaaaaaaaaaaaaaaaaaaaaaaaaaaaaaaaaaaaaaaaaaaaaaaaaaaaaaaaaaaaaaaaaaaaaaccgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttaattccctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatt

SEQ ID NO: 856 - protein, 5 aa, Artificial Sequence
  Description of Artificial Sequence: Synthetic peptide H1-1
  MOD_RES (1)..(3): Any naturally occurring amino acid
XXXMM

SEQ ID NO: 857 - protein, 5 aa, Artificial Sequence
  Description of Artificial Sequence: Synthetic peptide H1-2
  MOD_RES (2)..(4): Any naturally occurring amino acid
EXXXM

SEQ ID NO: 858 - protein, 5 aa, Artificial Sequence
  Description of Artificial Sequence: Synthetic peptide H1-3
  MOD_RES (3)..(5): Any naturally occurring amino acid
EYXXX

SEQ ID NO: 859 - protein, 5 aa, Artificial Sequence
  Description of Artificial Sequence: Synthetic peptide H1-4
  MOD_RES (1)..(1): Any naturally occurring amino acid
  MOD_RES (3)..(3): Any naturally occurring amino acid
  MOD_RES (5)..(5): Any naturally occurring amino acid
XYXMX

SEQ ID NO: 860 - protein, 17 aa, Artificial Sequence
  Description of Artificial Sequence: Synthetic peptide H2-1
  MOD_RES (1)..(3): Any naturally occurring amino acid
XXXQDGKNTYYADSVKG

SEQ ID NO: 861 - protein, 17 aa, Artificial Sequence
  Description of Artificial Sequence: Synthetic peptide H2-2
  MOD_RES (2)..(4): Any naturally occurring amino acid
RXXXDGKNTYYADSVKG

SEQ ID NO: 862 - protein, 17 aa, Artificial Sequence
  Description of Artificial Sequence: Synthetic peptide H2-3
  MOD_RES (3)..(5): Any naturally occurring amino acid
RIXXXGKNTYYADSVKG

SEQ ID NO: 863 - protein, 17 aa, Artificial Sequence
  Description of Artificial Sequence: Synthetic peptide H2-4
  MOD_RES (4)..(6): Any naturally occurring amino acid
RIGXXXKNTYYADSVKG

SEQ ID NO: 864 - protein, 17 aa, Artificial Sequence
  Description of Artificial Sequence: Synthetic peptide H2-5
  MOD_RES (5)..(7): Any naturally occurring amino acid
RIGQXXXNTYYADSVKG

SEQ ID NO: 865 - protein, 17 aa, Artificial Sequence
  Description of Artificial Sequence: Synthetic peptide H2-6
  MOD_RES (6)..(8): Any naturally occurring amino acid
RIGQDXXXTYYADSVKG

SEQ ID NO: 866 - protein, 17 aa, Artificial Sequence
  Description of Artificial Sequence: Synthetic peptide H2-7
  MOD_RES (7)..(9): Any naturally occurring amino acid
RIGQDGXXXYYADSVKG

SEQ ID NO: 867 - protein, 17 aa, Artificial Sequence
  Description of Artificial Sequence: Synthetic peptide H2-8
  MOD_RES (8)..(10): Any naturally occurring amino acid
RIGQDGKXXXYADSVKG

SEQ ID NO: 868 - protein, 17 aa, Artificial Sequence
  Description of Artificial Sequence: Synthetic peptide H2-9
  MOD_RES (9)..(11): Any naturally occurring amino acid
RIGQDGKNXXXADSVKG

SEQ ID NO: 869 - protein, 17 aa, Artificial Sequence
  Description of Artificial Sequence: Synthetic peptide H2-10
  MOD_RES (10)..(12): Any naturally occurring amino acid
RIGQDGKNTXXXDSVKG

SEQ ID NO: 870 - protein, 17 aa, Artificial Sequence
  Description of Artificial Sequence: Synthetic peptide H2-11
  MOD_RES (11)..(13): Any naturally occurring amino acid
RIGQDGKNTYXXXSVKG

SEQ ID NO: 871 - protein, 17 aa, Artificial Sequence
  Description of Artificial Sequence: Synthetic peptide H2-12
  MOD_RES (12)..(14): Any naturally occurring amino acid
RIGQDGKNTYYXXXVKG

SEQ ID NO: 872 - protein, 17 aa, Artificial Sequence
  Description of Artificial Sequence: Synthetic peptide H2-13
  MOD_RES (13)..(15): Any naturally occurring amino acid
RIGQDGKNTYYAXXXKG

SEQ ID NO: 873 - protein, 17 aa, Artificial Sequence
  Description of Artificial Sequence: Synthetic peptide H2-14
  MOD_RES (14)..(16): Any naturally occurring amino acid
RIGQDGKNTYYADXXXG

SEQ ID NO: 874 - protein, 17 aa, Artificial Sequence
  Description of Artificial Sequence: Synthetic peptide H2-15
  MOD_RES (15)..(17): Any naturally occurring amino acid
RIGQDGKNTYYADSXXX

SEQ ID NO: 875 - protein, 13 aa, Artificial Sequence
  Description of Artificial Sequence: Synthetic peptide H3-1
  MOD_RES (1)..(3): Any naturally occurring amino acid
XXXRVGVHHLFDY

SEQ ID NO: 876 - protein, 13 aa, Artificial Sequence
  Description of Artificial Sequence: Synthetic peptide H3-2
  MOD_RES (2)..(4): Any naturally occurring amino acid
YXXXVGVHHLFDY

SEQ ID NO: 877 - protein, 13 aa, Artificial Sequence
  Description of Artificial Sequence: Synthetic peptide H3-3
  MOD_RES (3)..(5): Any naturally occurring amino acid
YTXXXGVHHLFDY

SEQ ID NO: 878 - protein, 13 aa, Artificial Sequence
  Description of Artificial Sequence: Synthetic peptide H3-4
  MOD_RES (4)..(6): Any naturally occurring amino acid
YTGXXXVHHLFDY

SEQ ID NO: 879 - protein, 13 aa, Artificial Sequence
  Description of Artificial Sequence: Synthetic peptide H3-5
  MOD_RES (5)..(7): Any naturally occurring amino acid
YTGRXXXHHLFDY

SEQ ID NO: 880 - protein, 13 aa, Artificial Sequence
  Description of Artificial Sequence: Synthetic peptide H3-6
  MOD_RES (6)..(8): Any naturally occurring amino acid
YTGRVXXXHLFDY

SEQ ID NO: 881 - protein, 13 aa, Artificial Sequence
  Description of Artificial Sequence: Synthetic peptide H3-7
  MOD_RES (7)..(9): Any naturally occurring amino acid
YTGRVGXXXLFDY

SEQ ID NO: 882 - protein, 13 aa, Artificial Sequence
  Description of Artificial Sequence: Synthetic peptide H3-8
  MOD_RES (8)..(10): Any naturally occurring amino acid
YTGRVGVXXXFDY

SEQ ID NO: 883 - protein, 13 aa, Artificial Sequence
  Description of Artificial Sequence: Synthetic peptide H3-9
  MOD_RES (9)..(11): Any naturally occurring amino acid
YTGRVGVHXXXDY

SEQ ID NO: 884 - protein, 13 aa, Artificial Sequence
  Description of Artificial Sequence: Synthetic peptide H3-10
  MOD_RES (10)..(12): Any naturally occurring amino acid
YTGRVGVHHXXXY

SEQ ID NO: 885 - protein, 13 aa, Artificial Sequence
  Description of Artificial Sequence: Synthetic peptide H3-11
  MOD_RES (11)..(13): Any naturally occurring amino acid
YTGRVGVHHLXXX

SEQ ID NO: 886 - protein, 35 aa, Artificial Sequence
  Description of Artificial Sequence: Synthetic polypeptide ABT-2108
EYTMMRIGQDGKNTYYADSVKGYTGRVGVHHLFDY

SEQ ID NO: 887 - protein, 35 aa, Artificial Sequence
  Description of Artificial Sequence: Synthetic polypeptide ABT-2501
WEGMMRIGQDGKNTYYADSVKGYTGRVGVHHLFDY

SEQ ID NO: 888 - protein, 35 aa, Artificial Sequence
  Description of Artificial Sequence: Synthetic polypeptide ABT-2502
MESMMRIGQDGKNTYYADSVKGYTGRVGVHHLFDY

SEQ ID NO: 889 - protein, 35 aa, Artificial Sequence
  Description of Artificial Sequence: Synthetic polypeptide ABT-2503
EEKWMRIGQDGKNTYYADSVKGYTGRVGVHHLFDY

SEQ ID NO: 890 - protein, 35 aa, Artificial Sequence
  Description of Artificial Sequence: Synthetic polypeptide ABT-2504
DEGMMRIGQDGKNTYYADSVKGYTGRVGVHHLFDY

SEQ ID NO: 891 - protein, 35 aa, Artificial Sequence
  Description of Artificial Sequence: Synthetic polypeptide ABT-2505
EYGLIRIGQDGKNTYYADSVKGYTGRVGVHHLFDY

SEQ ID NO: 892 - protein, 35 aa, Artificial Sequence
  Description of Artificial Sequence: Synthetic polypeptide ABT-2506
EYTMMRCHEDGKNTYYADSVKGYTGRVGVHHLFDY

SEQ ID NO: 893 - protein, 35 aa, Artificial Sequence
  Description of Artificial Sequence: Synthetic polypeptide ABT-2507
EYTMMRITWTGKNTYYADSVKGYTGRVGVHHLFDY

SEQ ID NO: 894 - protein, 35 aa, Artificial Sequence
  Description of Artificial Sequence: Synthetic polypeptide ABT-2508
EYTMMRIGYMDKNTYYADSVKGYTGRVGVHHLFDY

SEQ ID NO: 895 - protein, 35 aa, Artificial Sequence
  Description of Artificial Sequence: Synthetic polypeptide ABT-2509
EYTMMRITYSGKNTYYADSVKGYTGRVGVHHLFDY

SEQ ID NO: 896 - protein, 35 aa, Artificial Sequence
  Description of Artificial Sequence: Synthetic polypeptide ABT-2510
EYTMMRCVWDGKNTYYADSVKGYTGRVGVHHLFDY

SEQ ID NO: 897 - protein, 35 aa, Artificial Sequence
  Description of Artificial Sequence: Synthetic polypeptide ABT-2511
EYTMMRIGQDGKNTVIRDSVKGYTGRVGVHHLFDY

SEQ ID NO: 898 - protein, 35 aa, Artificial Sequence
  Description of Artificial Sequence: Synthetic polypeptide ABT-2512
EYTMMRIGQDGKNTVLRDSVKGYTGRVGVHHLFDY

SEQ ID NO: 899 - protein, 35 aa, Artificial Sequence
  Description of Artificial Sequence: Synthetic polypeptide ABT-2513
EYTMMRIGQDGKNTVDRDSVKGYTGRVGVHHLFDY

SEQ ID NO: 900 - protein, 35 aa, Artificial Sequence
  Description of Artificial Sequence: Synthetic polypeptide ABT-2514
EYTMMRIGQDGKNTWTRDSVKGYTGRVGVHHLFDY

SEQ ID NO: 901 - protein, 35 aa, Artificial Sequence
  Description of Artificial Sequence: Synthetic polypeptide ABT-2515
EYTMMRIGQDGKNTYYRGYMKGYTGRVGVHHLFDY

SEQ ID NO: 902 - protein, 35 aa, Artificial Sequence
  Description of Artificial Sequence: Synthetic polypeptide ABT-2516
EYTMMRIGQDGKNTYYRVDVKGYTGRVGVHHLFDY

SEQ ID NO: 903 - protein, 35 aa, Artificial Sequence
  Description of Artificial Sequence: Synthetic polypeptide ABT-2517
EYTMMRIGQDGKNTYYADRTDGYTGRVGVHHLFDY

SEQ ID NO: 904 - protein, 35 aa, Artificial Sequence
  Description of Artificial Sequence: Synthetic polypeptide ABT-2518
EYTMMRIGQDGKNTYYRMDVKGYTGRVGVHHLFDY

SEQ ID NO: 905 - protein, 35 aa, Artificial Sequence
  Description of Artificial Sequence: Synthetic polypeptide ABT-2519
EYTMMRIGQDGKNTYARMSVKGYTGRVGVHHLFDY

SEQ ID NO: 906 - protein, 35 aa, Artificial Sequence
  Description of Artificial Sequence: Synthetic polypeptide ABT-2520
EYTMMRIGQDGKNTYYADRSFGYTGRVGVHHLFDY

SEQ ID NO: 907 - protein, 35 aa, Artificial Sequence
  Description of Artificial Sequence: Synthetic polypeptide ABT-2521
EYTMMRIGQDGKNTYYADSVKGYTGRILGHHLFDY

SEQ ID NO: 908 - protein, 35 aa, Artificial Sequence
  Description of Artificial Sequence: Synthetic polypeptide ABT-2522
EYTMMRIGQDGKNTYYADSVKGYTGRILHHHLFDY

SEQ ID NO: 909 - protein, 35 aa, Artificial Sequence
  Description of Artificial Sequence: Synthetic polypeptide ABT-2523
EYTMMRIGQDGKNTYYADSVKGYDGWVGVHHLFDY

SEQ ID NO: 910 - protein, 35 aa, Artificial Sequence
  Description of Artificial Sequence: Synthetic polypeptide ABT-2524
EYTMMRIGQDGKNTYYADSVKGYTGRVFNHHLFDY

SEQ ID NO: 911 - protein, 35 aa, Artificial Sequence
  Description of Artificial Sequence: Synthetic polypeptide ABT-2525
EYTMMRIGQDGKNTYYADSVKGYTGRILAHHLFDY

SEQ ID NO: 912 - protein, 35 aa, Artificial Sequence
  Description of Artificial Sequence: Synthetic polypeptide ABT-2526
EYTMMRIGQDGKNTYYADSVKGYTGRVLNHHLFDY

SEQ ID NO: 913 - protein, 35 aa, Artificial Sequence
  Description of Artificial Sequence: Synthetic polypeptide ABT-2527
EYTMMRIGQDGKNTYYADSVKGYTGRVFKHHLFDY

SEQ ID NO: 914 - protein, 35 aa, Artificial Sequence
  Description of Artificial Sequence: Synthetic polypeptide ABT-2528
EYTMMRIGQDGKNTYYADSVKGYTGRVLGHHLFDY

SEQ ID NO: 915 - protein, 35 aa, Artificial Sequence
  Description of Artificial Sequence: Synthetic polypeptide ABT-2529
EEGMMRIGQDGKNTYYADSVKGYTGRVGVHHLFDY

SEQ ID NO: 916 - protein, 35 aa, Artificial Sequence
  Description of Artificial Sequence: Synthetic polypeptide ABT-2530
EYTMMRIGQDGKNTYYADSVKGYTGRILEHHLFDY

SEQ ID NO: 917 - protein, 35 aa, Artificial Sequence
  Description of Artificial Sequence: Synthetic polypeptide ABT-2531
EYTMMRIGQDGKNTYYADSVKGYTGRIFSHHLFDY

SEQ ID NO: 918 - protein, 35 aa, Artificial Sequence
  Description of Artificial Sequence: Synthetic polypeptide ABT-2532
EYTMMRIGQDGKNTYYADSVKGYTGRIFLHHLFDY

SEQ ID NO: 919 - protein, 35 aa, Artificial Sequence
  Description of Artificial Sequence: Synthetic polypeptide ABT-2533x
DEGMMRIGQDGKNTYYADSVKGYTGRILGHHLFDY

SEQ ID NO: 920 - protein, 35 aa, Artificial Sequence
  Description of Artificial Sequence: Synthetic polypeptide ABT-2534x
DEGMMRITYSGKNTYYADSVKGYTGRIFSHHLFDY

SEQ ID NO: 921 - protein, 35 aa, Artificial Sequence
  Description of Artificial Sequence: Synthetic polypeptide ABT-2535x
DEGMMRIGQDGKNTYYADSVKGYTGRIFSHHLFDY

SEQ ID NO: 922 - protein, 35 aa, Artificial Sequence
  Description of Artificial Sequence: Synthetic polypeptide ABT-2536x
EEKWMRIGQDGKNTYYADSVKGYTGRILGHHLFDY

SEQ ID NO: 923 - protein, 35 aa, Artificial Sequence
  Description of Artificial Sequence: Synthetic polypeptide ABT-2537x
DEGMMRIGQDGKNTYYRMDVKGYTGRILGHHLFDY

SEQ ID NO: 924 - protein, 35 aa, Artificial Sequence
  Description of Artificial Sequence: Synthetic polypeptide ABT-2538x
DEGMMRITYSGKNTYYADSVKGYTGRILGHHLFDY

SEQ ID NO: 925 - DNA, 17 bp, Artificial Sequence
  Description of Artificial Sequence: Synthetic oligonucleotide
tcgcgatgcgcatggta

SEQ ID NO: 926 - DNA, 17 bp, Artificial Sequence
  Description of Artificial Sequence: Synthetic oligonucleotide
taccatgcgcatcgcga

SEQ ID NO: 927 - DNA, 15 bp, Artificial Sequence
  Description of Artificial Sequence: Synthetic oligonucleotide
acaagcgctgatgct

SEQ ID NO: 928 - DNA, 15 bp, Artificial Sequence
  Description of Artificial Sequence: Synthetic oligonucleotide
agcatcagcgcttgt

SEQ ID NO: 929 - DNA, 17 bp, Artificial Sequence
  Description of Artificial Sequence: Synthetic oligonucleotide
gtccagtgcgcatggta

SEQ ID NO: 930 - DNA, 17 bp, Artificial Sequence
  Description of Artificial Sequence: Synthetic oligonucleotide
taccatgcgcactggac

SEQ ID NO: 931 - DNA, 15 bp, Artificial Sequence
  Description of Artificial Sequence: Synthetic oligonucleotide
acaagcgctaaaaca

SEQ ID NO: 932 - DNA, 15 bp, Artificial Sequence
  Description of Artificial Sequence: Synthetic oligonucleotide
tgttttagcgcttgt

SEQ ID NO: 933 - DNA, 15 bp, Artificial Sequence
  Description of Artificial Sequence: Synthetic oligonucleotide
aagctacgtacggtg

SEQ ID NO: 934 - DNA, 15 bp, Artificial Sequence
  Description of Artificial Sequence: Synthetic oligonucleotide
caccgtacgtagctt

SEQ ID NO: 935 - DNA, 17 bp, Artificial Sequence
  Description of Artificial Sequence: Synthetic oligonucleotide
agcttatcgcgaaaggg

SEQ ID NO: 936 - DNA, 17 bp, Artificial Sequence
  Description of Artificial Sequence: Synthetic oligonucleotide
ccctttcgcgataagct

SEQ ID NO: 937 - DNA, 14 bp, Artificial Sequence
  Description of Artificial Sequence: Synthetic oligonucleotide
acaagcgttaaccc

SEQ ID NO: 938 - DNA, 14 bp, Artificial Sequence
  Description of Artificial Sequence: Synthetic oligonucleotide
gggttaacgcttca

SEQ ID NO: 939 - DNA, 15 bp, Artificial Sequence
  Description of Artificial Sequence: Synthetic oligonucleotide
acaagcgcgtcgacc

SEQ ID NO: 940 - DNA, 15 bp, Artificial Sequence
  Description of Artificial Sequence: Synthetic oligonucleotide
ggtcgacgcgcttgt

SEQ ID NO: 941 - protein, 108 aa, Artificial Sequence
  Description of Artificial Sequence: Synthetic polypeptide ABTI-95-1
DIQMTQSPSSLSASVGDRVTITCRASQPIHGNLRWYQQKPGKAPKLLIYNISNLQSGVPSRFSGSGSGTDFTLTISSLQPEDFATYHCQQGYRWPVTFGQGTKVEIKR

SEQ ID NO: 942 - protein, 108 aa, Artificial Sequence
  Description of Artificial Sequence: Synthetic polypeptide ABT1-95-2
DIQMTQSPSSLSASVGDRVTITCRASQPIHGNLRWYQQKPGKAPKLLIYSSSYLQSGVPSRFSGSGSGTDFTLTISSLQPEDFATYYCQQGYRWPVTFGQGTKVEIKR

SEQ ID NO: 943 - protein, 108 aa, Artificial Sequence
  Description of Artificial Sequence: Synthetic polypeptide ABTI-95-4
DIQMTQSPSSLSASVGDRVTITCRASQPIVRNLRWYQQKPGKAPKLLIYSSSYLQSGVPSRFSGSGSGTDFTLTISSLQPEDFATYHCQQGYRWPVTFGQGTKVEIKR

SEQ ID NO: 944 - protein, 108 aa, Artificial Sequence
  Description of Artificial Sequence: Synthetic polypeptide ABT1-95-8
DIQMTQSPSSLSASVGDRVTITCRASQPIQGNLRWYQQKPGKAPKLLIYSSSYLERGVPSRFSGSGSGTDFTLTISSLQPEDFATYHCQQGYRWPVTFGQGTKVEIKR

SEQ ID NO: 945 - protein, 108 aa, Artificial Sequence
  Description of Artificial Sequence: Synthetic polypeptide ABTI-95-13
DIQMTQSPSSLSASVGDRVTITCRASQPIVRNLRWYQQKPGKAPKLLIYSSSYLERGVPSRFSGSGSGTDFTLTISSLQPEDFATYHCQQGYRWPVTFGQGTKVEIKR

SEQ ID NO: 946 - protein, 108 aa, Artificial Sequence
  Description of Artificial Sequence: Synthetic polypeptide ABT1-95-14
DIQMTQSPSSLSASVGDRVTITCRASQPIVKNLRWYQQKPGKAPKLLIYSSSYLERGVPSRFSGSGSGTDFTLTISSLQPEDFATYHCQQGYRWPVTFGQGTKVEIKR

SEQ ID NO: 947 - protein, 108 aa, Artificial Sequence
  Description of Artificial Sequence: Synthetic polypeptide ABT1-95-A3
DIQMTQSPSSLSASVGDRVTITCRASKPGVRNMRWYQQKPGKAPKLLIYSVSYLERGVPSRFSGSGSGTDFTLTISSLQPEDFATYHCLQGYRWPPTFGQGTKVEIKR

SEQ ID NO: 948 - protein, 108 aa, Artificial Sequence
  Description of Artificial Sequence: Synthetic polypeptide ABT1-122-18
DIQMTQSPSSLSASVGDRVTITCRASQPIWTELNWYQQKPGKAPKLLVYGSSSLQSGVPSRFSGSGSGTDFTLTISSLQPEDFATYYCQQFAYFPATFGQGTKVEIKR

SEQ ID NO: 949 - protein, 108 aa, Artificial Sequence
  Description of Artificial Sequence: Synthetic polypeptide ABT-141-47
DIQMTQSPSSLSASVGDRVTITCRANQWIQKQLAWYQQKPGKAPKLLIYSSSHLQSGVPSRFSGSGSGTDFTLTISSLQPQDFATYYCQQHLRVPMTFGQGTKVEIKR

SEQ ID NO: 950 - protein, 108 aa, Artificial Sequence
  Description of Artificial Sequence: Synthetic polypeptide ABT-141-76
DIQMTQSPSSLSASVGDRVTITCRANQWIQKQLAWYQQKPGKAPKLLIYSSSHLQSGVPSRFSGSGSGTDFTLTISSLQPEDFATYYCQQHLRVPMTFGQGTKVEIKR

SEQ ID NO: 951 - protein, 11 aa, Artificial Sequence
  Description of Artificial Sequence: Synthetic peptide CDR1 ABT1-122-751x
RASQHIWTELN

SEQ ID NO: 952 - protein, 7 aa, Artificial Sequence
  Description of Artificial Sequence: Synthetic peptide CDR2 ABT1-122-751x
GSASRQK

SEQ ID NO: 953 - protein, 9 aa, Artificial Sequence
  Description of Artificial Sequence: Synthetic peptide CDR3 ABT1-122-751x
KQFAYYPNT

SEQ ID NO: 954 - DNA, 19 bp, Artificial Sequence
  Description of Artificial Sequence: Synthetic primer 2-108-Gap1Fwd
tgggtccgccaggctccag

SEQ ID NO: 955 - DNA, 20 bp, Artificial Sequence
  Description of Artificial Sequence: Synthetic primer 2-108-Gap1Rev
aaaggtgaatccggaggctg

SEQ ID NO: 956 - DNA, 24 bp, Artificial Sequence
  Description of Artificial Sequence: Synthetic primer 2-108Gap2Fwd
aatacatactacgcagactccgtg

SEQ ID NO: 957 - DNA, 18 bp, Artificial Sequence
  Description of Artificial Sequence: Synthetic primer 2-108-Gap2Rev
tgagacccactcgagacc

SEQ ID NO: 958 - DNA, 18 bp, Artificial Sequence
  Description of Artificial Sequence: Synthetic primer 2-108-Gap3Fwd
gactccgtgaagggccgg

SEQ ID NO: 959 - DNA, 19 bp, Artificial Sequence
  Description of Artificial Sequence: Synthetic primer 2-108-Gap3Rev
atcctgcccaatacgtgag

SEQ ID NO: 960 - DNA, 18 bp, Artificial Sequence
  Description of Artificial Sequence: Synthetic primer 2-108-Gap4Fwd
cggttcaccatctcccgc

SEQ ID NO: 961 - DNA, 24 bp, Artificial Sequence
  Description of Artificial Sequence: Synthetic primer 2-108-Gap4Rev
gtatgtattcttaccatcctgccc

SEQ ID NO: 962 - DNA, 25 bp, Artificial Sequence
  Description of Artificial Sequence: Synthetic primer 2-108-Gap5Fwd
catcatctttttgactactggggtc

SEQ ID NO: 963 - DNA, 21 bp, Artificial Sequence
  Description of Artificial Sequence: Synthetic primer 2-108-Gap5Rev
tttcgcacagtaatataccgc

SEQ ID NO: 964 - DNA, 20 bp, Artificial Sequence
  Description of Artificial Sequence: Synthetic primer 2-108-Gap6Fwd
gactactggggtcagggaac

SEQ ID NO: 965 - DNA, 20 bp, Artificial Sequence
  Description of Artificial Sequence: Synthetic primer 2-108-Gap6Rev
aacccgacccgtatatttcg

SEQ ID NO: 966 - DNA, 18 bp, Artificial Sequence
  Description of Artificial Sequence: Synthetic primer 2-108-Gap7Fwd
tggggtcagggaaccctg

SEQ ID NO: 967 - DNA, 20 bp, Artificial Sequence
  Description of Artificial Sequence: Synthetic primer 2-108-Gap7Rev
atgatgaacaccaacccgac

SEQ ID NO: 968 - DNA, 100 bp, Artificial Sequence
  Description of Artificial Sequence: Synthetic primer 1-95-15-L1
catcctccctgtctgcatctgtaggagaccgtgtcaccatcacttgccgggcaagtcagccgattgtgcggaacttaaggtggtatcagcagaaaccagg

SEQ ID NO: 969 - DNA, 100 bp, Artificial Sequence
  Description of Artificial Sequence: Synthetic primer 1-95-15-L2
tggtatcagcagaaaccagggaaagcccctaagctcctgatctattcttcgtcctatttggagcccggggtcccatcacgtttcagtggtagtggatccg

SEQ ID NO: 970 - DNA, 100 bp, Artificial Sequence
  Description of Artificial Sequence: Synthetic primer 1-95-15-L3
actctcaccatcagcagtctgcaacccgaagattttgctacgtaccactgtcaacaggggtatcgttggcctgttacgttcggccaagggaccaaggtgg

SEQ ID NO: 971 - DNA, 33 bp, Artificial Sequence
  Description of Artificial Sequence: Synthetic primer 1-122 Gap 1 Rev new
gcaagtgatggtgacacggtctcctacagatgc

SEQ ID NO: 972 - DNA, 30 bp, Artificial Sequence
  Description of Artificial Sequence: Synthetic primer 1-122 Gap 3 Rev new
atagatcaggagcttaggggctttccctgg

SEQ ID NO: 973 - DNA, 25 bp, Artificial Sequence
  Description of Artificial Sequence: Synthetic primer 1-95 Gap4 Rev
acagtggtacgtagcaaaatcttcg

SEQ ID NO: 974 - DNA, 22 bp, Artificial Sequence
  Description of Artificial Sequence: Synthetic primer pYD1 Fwd
agtaacgtttgtcagtaattgc

SEQ ID NO: 975 - DNA, 70 bp, Artificial Sequence
  Description of Artificial Sequence: Synthetic primer ABTVKSCFV Rev
ttagggataggcttaccttcgaagggccctctagactcgagggcggccgcacgtttgatttccaccttgg

SEQ ID NO: 976 - protein, 27 aa, Artificial Sequence
  Description of Artificial Sequence: Synthetic peptide ABT1-95-15
RASQPIVRNLRSSSYLEPQQGYRWPVT

SEQ ID NO: 977 - protein, 27 aa, Artificial Sequence
  Description of Artificial Sequence: Synthetic peptide ABT1-95-15
RASQSNLRNLRSSSYLEPQQGYRWPVT

SEQ ID NO: 978 - protein, 27 aa, Artificial Sequence
  Description of Artificial Sequence: Synthetic peptide ABT1-95-15
RASRTPVRNLRSSSYLEPQQGYRWPVT

SEQ ID NO: 979 - protein, 27 aa, Artificial Sequence
  Description of Artificial Sequence: Synthetic peptide ABT1-95-15
RANRTRVRNLRSSSYLEPQQGYRWPVT

SEQ ID NO: 980 - protein, 27 aa, Artificial Sequence
  Description of Artificial Sequence: Synthetic peptide ABT1-95-15
RKNNPFVRNLRSSSYLEPQQGYRWPVT

SEQ ID NO: 981 - protein, 27 aa, Artificial Sequence
  Description of Artificial Sequence: Synthetic peptide ABT1-95-15
RKNHPNMRNLRSSSYLEPQQGYRWPVT

SEQ ID NO: 982 - protein, 27 aa, Artificial Sequence
  Description of Artificial Sequence: Synthetic peptide ABT1-95-15
RKNHPHIRNLRSSSYLEPQQGYRWPVT

SEQ ID NO: 983 - protein, 27 aa, Artificial Sequence
  Description of Artificial Sequence: Synthetic peptide ABT1-95-15
RKTHPTVRNLRSSSYLEPQQGYRWPVT

SEQ ID NO: 984 - protein, 27 aa, Artificial Sequence
  Description of Artificial Sequence: Synthetic peptide ABT1-95-15
RKAHPMVRNLRSSSYLEPQQGYRWPVT

SEQ ID NO: 985 - protein, 27 aa, Artificial Sequence
  Description of Artificial Sequence: Synthetic peptide ABT1-95-15
RKLQPFVRNLRSSSYLEPQQGYRWPVT

SEQ ID NO: 986 - protein, 27 aa, Artificial Sequence
  Description of Artificial Sequence: Synthetic peptide ABT1-95-15
RKSSPMVRNLRSSSYLEPQQGYRWPVT

SEQ ID NO: 987 - protein, 27 aa, Artificial Sequence
  Description of Artificial Sequence: Synthetic peptide ABT1-95-15
LKRHPSVRNLRSSSYLEPQQGYRWPVT

SEQ ID NO: 988 - protein, 27 aa, Artificial Sequence
  Description of Artificial Sequence: Synthetic peptide ABT1-95-15
LKRQPSVRNLRSSSYLEPQQGYRWPVT

SEQ ID NO: 989 - protein, 27 aa, Artificial Sequence
  Description of Artificial Sequence: Synthetic peptide ABT1-95-15
RKSHPFVRNLRSSSYLEPQQGYRWPVT

SEQ ID NO: 990 - protein, 27 aa, Artificial Sequence
  Description of Artificial Sequence: Synthetic peptide ABT1-95-15
RASQTRVQNLRSSSYLEPQQGYRWPVT

SEQ ID NO: 991 - protein, 27 aa, Artificial Sequence
  Description of Artificial Sequence: Synthetic peptide ABT1-95-15
RARRAPVRNLRSSSYLEPQQGYRWPVT

SEQ ID NO: 992 - protein, 27 aa, Artificial Sequence
  Description of Artificial Sequence: Synthetic peptide ABT1-95-15
RARNTPVRNLRSSSYLEPQQGYRWPVT

SEQ ID NO: 993 - protein, 27 aa, Artificial Sequence
  Description of Artificial Sequence: Synthetic peptide ABT1-95-15
RASRPNVRNLRSSSYLEPQQGYRWPVT

SEQ ID NO: 994 - protein, 27 aa, Artificial Sequence
  Description of Artificial Sequence: Synthetic peptide ABT1-95-15
RASRPIVRNLRSSSYLEPQQGYRWPVT

SEQ ID NO: 995 - protein, 27 aa, Artificial Sequence
  Description of Artificial Sequence: Synthetic peptide ABT1-95-15
RGSRPGIRNLRSSSYLEPQQGYRWPVT

SEQ ID NO: 996 - protein, 27 aa, Artificial Sequence
  Description of Artificial Sequence: Synthetic peptide ABT1-95-15
RRSGPNVRNLRSSSYLEPQQGYRWPVT

SEQ ID NO: 997 - protein, 27 aa, Artificial Sequence
  Description of Artificial Sequence: Synthetic peptide ABT1-95-15
LKSHPHVRNLRSSSYLEPQQGYRWPVT

SEQ ID NO: 998 - protein, 27 aa, Artificial Sequence
  Description of Artificial Sequence: Synthetic peptide ABT1-95-15
RASQPIVRNLRSVSYLEPQQGYRWPVT

SEQ ID NO: 999 - protein, 27 aa, Artificial Sequence
  Description of Artificial Sequence: Synthetic peptide ABT1-95-15
RASQPIVRNLRSRSYLEPQQGYRWPVT

SEQ ID NO: 1000 - protein, 27 aa, Artificial Sequence
  Description of Artificial Sequence: Synthetic peptide ABT1-95-15
RASQPIVRNLRSKSYLEPQQGYRWPVT

SEQ ID NO: 1001 - protein, 27 aa, Artificial Sequence
  Description of Artificial Sequence: Synthetic peptide ABT1-95-15
RASQPIVRNLRSVSWLEPQQGYRWPVT

SEQ ID NO: 1002 - protein, 27 aa, Artificial Sequence
  Description of Artificial Sequence: Synthetic peptide ABT1-95-15
RASQPIVRNLRSISYLEPQQGYRWPVT

SEQ ID NO: 1003 - protein, 27 aa, Artificial Sequence
  Description of Artificial Sequence: Synthetic peptide ABT1-95-15
RASQPIVRNLRSTKNVERQQGYRWPVT

SEQ ID NO: 1004 - protein, 27 aa, Artificial Sequence
  Description of Artificial Sequence: Synthetic peptide ABT1-95-15
RASQPIVRNLRSWSFLQPQQGYRWPVT

SEQ ID NO: 1005 - protein, 27 aa, Artificial Sequence
  Description of Artificial Sequence: Synthetic peptide ABT1-95-15
RASQPIVRNLRSSNYLAPQQGYRWPVT

SEQ ID NO: 1006 - protein, 27 aa, Artificial Sequence
  Description of Artificial Sequence: Synthetic peptide ABT1-95-15
RASQPIVRNLRARSYLEPQQGYRWPVT

SEQ ID NO: 1007 - protein, 27 aa, Artificial Sequence
  Description of Artificial Sequence: Synthetic peptide ABT1-95-15
RASQPIVRNLRSSSYLEPRMGYRWPVT

SEQ ID NO: 1008 - protein, 27 aa, Artificial Sequence
  Description of Artificial Sequence: Synthetic peptide ABT1-95-15
RASQPIVRNLRSSSYLEPKAGYVWPVP

SEQ ID NO: 1009 - protein, 27 aa, Artificial Sequence
  Description of Artificial Sequence: Synthetic peptide ABT1-95-15
RASQPIVRNLRSSSYLEPKAGYRWPVT

SEQ ID NO: 1010 - protein, 27 aa, Artificial Sequence
  Description of Artificial Sequence: Synthetic peptide ABT1-95-15
RASQPIVRNLRSSSYLEPRSGYRWPVT

SEQ ID NO: 1011 - protein, 27 aa, Artificial Sequence
  Description of Artificial Sequence: Synthetic peptide ABT1-95-A3
RASKPGVRNMRSVSYLEPLQGYRWPPT

SEQ ID NO: 1012 - protein, 27 aa, Artificial Sequence
  Description of Artificial Sequence: Synthetic peptide ABT1-95-A3
RASKPGVRNMRSVSYLEPQQGYRWPVT

SEQ ID NO: 1013 - protein, 27 aa, Artificial Sequence
  Description of Artificial Sequence: Synthetic peptide ABT1-95-A3
RASKPGVRNMRSVSYLEPRQGYRWPVT

SEQ ID NO: 1014 - protein, 27 aa, Artificial Sequence
  Description of Artificial Sequence: Synthetic peptide ABT1-95-A6
RASKPGVRNMRAKSYLEPKQGYRWPVQ

SEQ ID NO: 1015 - protein, 27 aa, Artificial Sequence
  Description of Artificial Sequence: Synthetic peptide ABT1-95-A6
RASKPGVRNMRAKSYLEPQQGYRWPVT

SEQ ID NO: 1016 - protein, 27 aa, Artificial Sequence
  Description of Artificial Sequence: Synthetic peptide ABT1-95-A6
RASKPGVRNMRSKSYLEPQQGYRWPVT

SEQ ID NO: 1017 - protein, 27 aa, Artificial Sequence
  Description of Artificial Sequence: Synthetic peptide ABT1-95-A6
RASKPGVRNMRSSSYLNPQQGYRWPVT

SEQ ID NO: 1018 - protein, 27 aa, Artificial Sequence
  Description of Artificial Sequence: Synthetic peptide ABT1-95-A6
RASKAGVRNLRSVSYLEPLQGYRWPPT

SEQ ID NO: 1019 - protein, 27 aa, Artificial Sequence
  Description of Artificial Sequence: Synthetic peptide ABT1-95-A6
RASKAGVRNLRSVSWLEPRQGYVWPVP

SEQ ID NO: 1020 - protein, 27 aa, Artificial Sequence
  Description of Artificial Sequence: Synthetic peptide ABT1-95-A4
RASRPGVRNLRSRSFLEPLQGYRWPPT

SEQ ID NO: 1021 - protein, 27 aa, Artificial Sequence
  Description of Artificial Sequence: Synthetic peptide ABT1-95-A4
RASRPGVRNLRSRSFLEPQQGYRWPVT

SEQ ID NO: 1022 - protein, 27 aa, Artificial Sequence
  Description of Artificial Sequence: Synthetic peptide ABT1-95-A4
RASRPGVRNLRSVSFLEPRQGYVWPVP

SEQ ID NO: 1023 - protein, 27 aa, Artificial Sequence
  Description of Artificial Sequence: Synthetic peptide ABT1-95-A4
RASRPGVRNLRSVSYLEPLQGYRWPPT

SEQ ID NO: 1024 - protein, 27 aa, Artificial Sequence
  Description of Artificial Sequence: Synthetic peptide ABT1-95-A1
RASRPGVRNLRHVSDLEPRQGYVWPVP

SEQ ID NO: 1025 - protein, 27 aa, Artificial Sequence
  Description of Artificial Sequence: Synthetic peptide ABT1-95-A1
RGSRPGIRNLRSVSFLEPLQGYRWPPT

SEQ ID NO: 1026 - protein, 27 aa, Artificial Sequence
  Description of Artificial Sequence: Synthetic peptide ABT1-95-A1
RGSRPGIRNLRASSNLEPQQGYRWPVT

SEQ ID NO: 1027 - protein, 27 aa, Artificial Sequence
  Description of Artificial Sequence: Synthetic peptide ABT1-95-A5
RASRTPVRNLRSRSFLEPLQGYRWPPT

SEQ ID NO: 1028 - protein, 27 aa, Artificial Sequence
  Description of Artificial Sequence: Synthetic peptide ABT1-95-A5
QASQPGVRNMRSVSFLEPRQGYRWPVT

SEQ ID NO: 1029 - protein, 27 aa, Artificial Sequence
  Description of Artificial Sequence: Synthetic peptide ABT1-95-A5
QASQPGVRNMRSVSYLEPQQGYRWPVT

SEQ ID NO: 1030 - protein, 27 aa, Artificial Sequence
  Description of Artificial Sequence: Synthetic peptide ABT1-95-A5
QASQPGVRNMRSTSSLQPQQGYRWPVT

SEQ ID NO: 1031 - protein, 27 aa, Artificial Sequence
  Description of Artificial Sequence: Synthetic peptide ABT1-95-A2
RILQPPGRNLRSKSFLEPQQGYRWPVT

SEQ ID NO: 1032 - protein, 27 aa, Artificial Sequence
  Description of Artificial Sequence: Synthetic peptide ABT1-95-A2
RASHGGVRNLRSASYLEPQQGYRWPVT

SEQ ID NO: 1033 - protein, 27 aa, Artificial Sequence
  Description of Artificial Sequence: Synthetic peptide ABT1-95-A2
RASHSPVRNLRSVSYLEPKAGYVWPVP

SEQ ID NO: 1034 - protein, 27 aa, Artificial Sequence
  Description of Artificial Sequence: Synthetic peptide ABT1-95-A2
RAGHPRVRNLRSSSYLQPQQGYRWPVT

SEQ ID NO: 1035 - protein, 27 aa, Artificial Sequence
  Description of Artificial Sequence: Synthetic peptide ABT1-95-A2
RASNQRVRNLRSVSYLEPQQGYRWPVT

SEQ ID NO: 1036 - protein, 27 aa, Artificial Sequence
  Description of Artificial Sequence: Synthetic peptide ABT1-95-A2
RKNHPDVRNLRSSSLLEPQQGYRWPVT

SEQ ID NO: 1037 - protein, 27 aa, Artificial Sequence
  Description of Artificial Sequence: Synthetic peptide ABT1-95-A2
RKSQPNMRNLRSTSLLDRQQGYRWPVT

SEQ ID NO: 1038 - protein, 27 aa, Artificial Sequence
  Description of Artificial Sequence: Synthetic peptide ABT1-95-A2
RASQPGVRNLRSSSYLEPQQGYRWPVT

SEQ ID NO: 1039 - protein, 27 aa, Artificial Sequence
  Description of Artificial Sequence: Synthetic peptide ABT1-95-A2
RASQPSVRNLRSKSYLEPQQGYRWPVT

SEQ ID NO: 1040 - DNA, 30 bp, Artificial Sequence
  Description of Artificial Sequence: Synthetic primer 2-108 Gap 1 Fwd new
tgggtccgccaggctccagggaagggtctc

SEQ ID NO: 1041 - DNA, 30 bp, Artificial Sequence
  Description of Artificial Sequence: Synthetic primer 2-108 Gap 1 Rev new
aaaggtgaatccggaggctgcacaggagag

SEQ ID NO: 1042 - DNA, 30 bp, Artificial Sequence
  Description of Artificial Sequence: Synthetic primer 2-108 Gap 2 Fwd new
aatacatactacgcagactccgtgaagggc

SEQ ID NO: 1043 - DNA, 30 bp, Artificial Sequence
  Description of Artificial Sequence: Synthetic primer 2-108 Gap 2 Rev new
tgagacccactcgagacccttccctggagc

SEQ ID NO: 1044 - DNA, 30 bp, Artificial Sequence
  Description of Artificial Sequence: Synthetic primer 2-108 Gap 3 Fwd new
gactccgtgaagggccggttcaccatctcc

SEQ ID NO: 1045 - DNA, 30 bp, Artificial Sequence
  Description of Artificial Sequence: Synthetic primer 2-108 Gap 3 Rev new
atcctgcccaatacgtgagacccactcgag

SEQ ID NO: 1046 - DNA, 30 bp, Artificial Sequence
  Description of Artificial Sequence: Synthetic primer 2-108 Gap 4 Fwd new
cggttcaccatctcccgcgacaattccaag

SEQ ID NO: 1047 - DNA, 30 bp, Artificial Sequence
  Description of Artificial Sequence: Synthetic primer 2-108 Gap 4 Rev new
gtatgtattcttaccatcctgcccaatacg

SEQ ID NO: 1048 - DNA, 32 bp, Artificial Sequence
  Description of Artificial Sequence: Synthetic primer 2-108 Gap 5 Fwd new
catcatctttttgactactggggtcagggaac

SEQ ID NO: 1049 - DNA, 30 bp, Artificial Sequence
  Description of Artificial Sequence: Synthetic primer 2-108 Gap 5 Rev new
tttcgcacagtaatataccgcggtgtcctc

SEQ ID NO: 1050 - DNA, 30 bp, Artificial Sequence
  Description of Artificial Sequence: Synthetic primer 2-108 Gap 6 Fwd new
gactactggggtcagggaaccctggtcacc

SEQ ID NO: 1051 - DNA, 33 bp, Artificial Sequence
  Description of Artificial Sequence: Synthetic primer 2-108 Gap 6 Rev new
aacccgacccgtatatttcgcacagtaatatac

SEQ ID NO: 1052 - DNA, 32 bp, Artificial Sequence
  Description of Artificial Sequence: Synthetic primer 1-122 Gap 1 Fwd new
actgagttaaattggtatcagcagaaaccagg

SEQ ID NO: 1053 - DNA, 33 bp, Artificial Sequence; identical to SEQ ID NO: 971
  Description of Artificial Sequence: Synthetic primer 1-122 Gap 1 Rev new

SEQ ID NO: 1054 - DNA, 33 bp, Artificial Sequence
  Description of Artificial Sequence: Synthetic primer 1-122 Gap 2 Fwd new
tggtatcagcagaaaccagggaaagcccctaag

SEQ ID NO: 1055 - DNA, 28 bp, Artificial Sequence
  Description of Artificial Sequence: Synthetic primer 1-122 Gap 2 Rev new
cggctgacttgcccggcaagtgatggtg

SEQ ID NO: 1056 - DNA, 29 bp, Artificial Sequence
  Description of Artificial Sequence: Synthetic primer 1-122 Gap 3 Fwd new
ggggtcccatcacgtttcagtggcagtgg

SEQ ID NO: 1057 - DNA, 30 bp, Artificial Sequence; identical to SEQ ID NO: 972
  Description of Artificial Sequence: Synthetic primer 1-122 Gap 3 Rev new

SEQ ID NO: 1058 - DNA, 33 bp, Artificial Sequence
  Description of Artificial Sequence: Synthetic primer 1-122 Gap 4 Fwd new
gctacgttcggccaagggaccaaggtggaaatc

SEQ ID NO: 1059 - DNA, 33 bp, Artificial Sequence
  Description of Artificial Sequence: Synthetic primer 1-122 Gap 4 Rev new
acagtagtacgtagcaaaatcttcaggttgcag

SEQ ID NO: 1060 - DNA, 32 bp, Artificial Sequence
  Description of Artificial Sequence: Synthetic primer 1-122 Gap 5 Fwd new
ttcggccaagggaccaaggtggaaatcaaacg

SEQ ID NO: 1061 - DNA, 33 bp, Artificial Sequence
  Description of Artificial Sequence: Synthetic primer
  Synthetic primer:  1-122 Gap 5 Rev new
agcaaactgttgacagtagtacgtagcaaaatc

SEQ ID NO: 1062 - DNA, 23 bp, Artificial Sequence
  Description of Artificial Sequence: Synthetic primer 2-108-CDR1F
caagtatttcggagtgcctgaac

SEQ ID NO: 1063 - DNA, 23 bp, Artificial Sequence
  Description of Artificial Sequence: Synthetic primer 2-108-CDR2F
gtccgccaggctccagggaaagg

SEQ ID NO: 1064 - DNA, 23 bp, Artificial Sequence
  Description of Artificial Sequence: Synthetic primer 2-108-CDR2R
tcgcacagtaatataccgcggtg

SEQ ID NO: 1065 - DNA, 24 bp, Artificial Sequence
  Description of Artificial Sequence: Synthetic primer 2-108-CDR3R
gcattggtgactattgagcacgtg

SEQ ID NO: 1066 - protein, 35 aa, Artificial Sequence
  Description of Artificial Sequence: Synthetic polypeptide ABT2-108-601
EESWMRIGQDGKNTYYADSVKGYTGRVGVHHLFDY

SEQ ID NO: 1067 - protein, 35 aa, Artificial Sequence
  Description of Artificial Sequence: Synthetic polypeptide ABT2-108-602
EEKYMRIGQDGKNTYYADSVKGYTGRVGVHHLFDY

SEQ ID NO: 1068 - protein, 35 aa, Artificial Sequence
  Description of Artificial Sequence: Synthetic polypeptide ABT2-108-603
EYTMMRITDAGKNTYYADSVKGYTGRVGVHHLFDY

SEQ ID NO: 1069 - protein, 35 aa, Artificial Sequence
  Description of Artificial Sequence: Synthetic polypeptide ABT2-108-604
EYTMMRVTYDGKNTYYADSVKGYTGRVGVHHLFDY

SEQ ID NO: 1070 - protein, 35 aa, Artificial Sequence
  Description of Artificial Sequence: Synthetic polypeptide ABT2-108-605
EYTMMRIGQDGKNTYYREDVKGYTGRVGVHHLFDY

SEQ ID NO: 1071 - protein, 35 aa, Artificial Sequence
  Description of Artificial Sequence: Synthetic polypeptide ABT2-108-606
EYTMMRIGQDGKNTYYRSSVKGYTGRVGVHHLFDY

SEQ ID NO: 1072 - protein, 35 aa, Artificial Sequence
  Description of Artificial Sequence: Synthetic polypeptide ABT2-108-607
EYTMMRIGQDGKNTYYRSDVKGYTGRVGVHHLFDY

SEQ ID NO: 1073 - protein, 35 aa, Artificial Sequence
  Description of Artificial Sequence: Synthetic polypeptide ABT2-108-608
EYTMMRIGQDGKNTYTRDSVKGYTGRVGVHHLFDY

SEQ ID NO: 1074 - protein, 35 aa, Artificial Sequence
  Description of Artificial Sequence: Synthetic polypeptide ABT2-108-609
EYTMMRIGQDGKNTVYRDSVKGYTGRVGVHHLFDY

SEQ ID NO: 1075 - protein, 35 aa, Artificial Sequence
  Description of Artificial Sequence: Synthetic polypeptide ABT2-108-610
EYTMMRIGQDGKNTVVRDSVKGYTGRVGVHHLFDY

SEQ ID NO: 1076 - protein, 35 aa, Artificial Sequence; identical to SEQ ID NO: 898
  Description of Artificial Sequence: Synthetic polypeptide ABT2-108-611

SEQ ID NO: 1077 - protein, 35 aa, Artificial Sequence
  Description of Artificial Sequence: Synthetic polypeptide ABT2-108-612
EYTMMRIGQDGKNTYYADSVKGYTGRIMGHHLFDY

SEQ ID NO: 1078 - protein, 35 aa, Artificial Sequence
  Description of Artificial Sequence: Synthetic polypeptide ABT2-108-613
EYTMMRIGQDGKNTYYADSVKGYTGRVFEHHLFDY

SEQ ID NO: 1079 - protein, 35 aa, Artificial Sequence
  Description of Artificial Sequence: Synthetic polypeptide ABT2-108-614
EYTMMRIGQDGKNTYYADSVKGYTGRILRHHLFDY

SEQ ID NO: 1080 - protein, 35 aa, Artificial Sequence; identical to SEQ ID NO: 897
  Description of Artificial Sequence: Synthetic polypeptide ABT2-108-615

SEQ ID NO: 1081 - protein, 35 aa, Artificial Sequence
  Description of Artificial Sequence: Synthetic polypeptide ABT2-108-616
EYTMMRIGQDGKNTYYADSVKGYTGRIYNHHLFDY

SEQ ID NO: 1082 - protein, 35 aa, Artificial Sequence
  Description of Artificial Sequence: Synthetic polypeptide ABT2-108-617
EYTMMRIGQDGKNTYYADSVKGYTGRIFTHHLFDY

SEQ ID NO: 1083 - protein, 35 aa, Artificial Sequence
  Description of Artificial Sequence: Synthetic polypeptide ABT2-108-618
EEYFMRIGQDGKNTYYADSVKGYTGRVGVHHLFDY

SEQ ID NO: 1084 - protein, 34 aa, Artificial Sequence
  Description of Artificial Sequence: Synthetic polypeptide ABT2-108-619
EYTMMRHGWDGKKYYADSVKGYTGRVGVHHLFDY

SEQ ID NO: 1085 - protein, 28 aa, Artificial Sequence
  Description of Artificial Sequence: Synthetic peptide ABT1-122
RASQPIWTELNGSSSLQSQQFAYFPATF

SEQ ID NO: 1086 - protein, 28 aa, Artificial Sequence
  Description of Artificial Sequence: Synthetic peptide ABT1-122-501
RFSYPIWTELNGSSSLQSQQFAYFPATF

SEQ ID NO: 1087 - protein, 28 aa, Artificial Sequence
  Description of Artificial Sequence: Synthetic peptide ABT1-122-502
RAVYLIWTELNGSSSLQSQQFAYFPATF

SEQ ID NO: 1088 - protein, 28 aa, Artificial Sequence
  Description of Artificial Sequence: Synthetic peptide ABT1-122-503
RASQPIWTELNGSSSLQSEQFAYFPATF

SEQ ID NO: 1089 - protein, 28 aa, Artificial Sequence
  Description of Artificial Sequence: Synthetic peptide ABT1-122-504
RASQPIWTELNGSSSLQSKQFAYFSATF

SEQ ID NO: 1090 - protein, 28 aa, Artificial Sequence
  Description of Artificial Sequence: Synthetic peptide ABT1-122-505
RASQPIWTELNGSSSLQSKQFAYFPATF

SEQ ID NO: 1091 - protein, 28 aa, Artificial Sequence
  Description of Artificial Sequence: Synthetic peptide ABT1-122-506
RASQPIWTELNGSMHTQSQQFAYFPATF

SEQ ID NO: 1092 - protein, 28 aa, Artificial Sequence
  Description of Artificial Sequence: Synthetic peptide ABT1-122-507
RASQPIWTELNRSSSLQSQQFAYFPATF

SEQ ID NO: 1093 - protein, 28 aa, Artificial Sequence
  Description of Artificial Sequence: Synthetic peptide ABT1-122-508
RASQPIWTELNGSSSLQRQQFAYFPATF

SEQ ID NO: 1094 - protein, 28 aa, Artificial Sequence
  Description of Artificial Sequence: Synthetic peptide ABT1-122-509
RASQPIWTELNGHAELQSQQFAYFPATF

SEQ ID NO: 1095 - protein, 29 aa, Artificial Sequence
  Description of Artificial Sequence: Synthetic peptide ABT1-6
GAYDMQSINKSGALTSYDSVKGGWASFDY

SEQ ID NO: 1096 - protein, 29 aa, Artificial Sequence
  Description of Artificial Sequence: Synthetic peptide ABT1-6-3
GAYDMQSIYKSGALTSYDSVKGGWASFDY

SEQ ID NO: 1097 - protein, 29 aa, Artificial Sequence
  Description of Artificial Sequence: Synthetic peptide ABT1-6-15
VRYDMASINKSGALTSYDSVKGGWASFDY

SEQ ID NO: 1098 - protein, 29 aa, Artificial Sequence
  Description of Artificial Sequence: Synthetic peptide ABT1-6-23
VRYDMASIYKSGALTSYDSVKGGWASFDY

SEQ ID NO: 1099 - DNA, 36 bp, Artificial Sequence
  Description of Artificial Sequence: Synthetic primer StufferLightSignal (SLS)-Rev
tcggcataccatgcgcatcgcgagccggggaaccac

SEQ ID NO: 1100 - DNA, 29 bp, Artificial Sequence
  Description of Artificial Sequence: Synthetic primer StufferLightSignal (SLS)-Fwd
cgatgcgcatggtatgccgaaagggatgc

SEQ ID NO: 1101 - DNA, 25 bp, Artificial Sequence
  Description of Artificial Sequence: Synthetic primer StufferHeavySignal (SHS)-Rev
gcactggacaccttttaaaatcgcg

SEQ ID NO: 1102 - DNA, 46 bp, Artificial Sequence
  Description of Artificial Sequence: Synthetic primer StufferHeavySignal (SHS)-Fwd
cgattttaaaaggtgtccagtgcgcatggtatgccgaaagggatgc

SEQ ID NO: 1103 - DNA, 20 bp, Artificial Sequence
  Description of Artificial Sequence: Synthetic primer pEF-BOS-Rev
ggagacctgatactctcaag

SEQ ID NO: 1104 - DNA, 18 bp, Artificial Sequence
  Description of Artificial Sequence: Synthetic primer pEF-BOS-Fwd
tcaggtgtcgtgaggaat

SEQ ID NO: 1105 - DNA, 36 bp, Artificial Sequence
  Description of Artificial Sequence: Synthetic primer mIgG2a-Rev
gttttagcgctacactggacaccttttaaaatcgcg

SEQ ID NO: 1106 - DNA, 36 bp, Artificial Sequence
  Description of Artificial Sequence: Synthetic primer mIgG2a-Fwd
ggtgtccagtgtagcgctaaaacaacagccccatcg

SEQ ID NO: 1107 - DNA, 35 bp, Artificial Sequence
  Description of Artificial Sequence: Synthetic primer mIgG1-Rev
cgttttagcgctacactggacaccttttaaaatcg

SEQ ID NO: 1108 - DNA, 35 bp, Artificial Sequence
  Description of Artificial Sequence: Synthetic primer mIgG1-Fwd
ggtgtccagtgtagcgctaaaacgacacccccatc

SEQ ID NO: 1109 - DNA, 36 bp, Artificial Sequence
  Description of Artificial Sequence: Synthetic primer mCkappa-Rev
gcagcatcagcgctgcatcgcgagccggggaaccac

SEQ ID NO: 1110 - DNA, 34 bp, Artificial Sequence
  Description of Artificial Sequence: Synthetic primer mCkappa-Fwd
ggctcgcgatgcagcgctgatgctgcaccaactg

SEQ ID NO: 1111 - DNA, 18 bp, Artificial Sequence
  Description of Artificial Sequence: Synthetic primer LambdaStuffer-Rev
gcttgtcacccaggaacg

SEQ ID NO: 1112 - DNA, 22 bp, Artificial Sequence
  Description of Artificial Sequence: Synthetic primer LambdaStuffer-Fwd
cgaaagggatgctgaaattgag

SEQ ID NO: 1113 - DNA, 30 bp, Artificial Sequence
  Description of Artificial Sequence: Synthetic primer LambdaSignal-Rev
catccctttcgcgataagcttcctgtgcag

SEQ ID NO: 1114 - DNA, 33 bp, Artificial Sequence
  Description of Artificial Sequence: Synthetic primer LambdaSignal-Fwd
gaagcttatcgcgaaagggatgctgaaattgag

SEQ ID NO: 1115 - DNA, 31 bp, Artificial Sequence
  Description of Artificial Sequence: Synthetic primer hCLambda-Rev
gccttgggttaacgcttgtcacccaggaacg

SEQ ID NO: 1116 - DNA, 36 bp, Artificial Sequence
  Description of Artificial Sequence: Synthetic primer hCLambda-Fwd
ggtgacaagcgttaacccaaggctgccccctcggtc

SEQ ID NO: 1117 - DNA, 33 bp, Artificial Sequence
  Description of Artificial Sequence: Synthetic primer hCkappa-Rev2
cagccaccgtacgtagcttgtcacccaggaacg

SEQ ID NO: 1118 - DNA, 33 bp, Artificial Sequence
  Description of Artificial Sequence: Synthetic primer hCkappa-Fwd2
gtgacaagctacgtacggtggctgcaccatctg

SEQ ID NO: 1119 - DNA, 30 bp, Artificial Sequence
  Description of Artificial Sequence: Synthetic primer hCGamma1-Rev
cttggtcgacgcgcttgtcacccaggaacg

SEQ ID NO: 1120 - DNA, 34 bp, Artificial Sequence
  Description of Artificial Sequence: Synthetic primer hCGamma1-Fwd
ggtgacaagcgcgtcgaccaagggcccatcggtc

SEQ ID NO: 1121 - DNA, 26 bp, Artificial Sequence
  Description of Artificial Sequence: Synthetic primer 5'Sal198
tctacgactacggtatggacgtctgg

SEQ ID NO: 1122 - DNA, 22 bp, Artificial Sequence
  Description of Artificial Sequence: Synthetic primer 3'Sal198
gccgtccacgtaccagttgaac

SEQ ID NO: 1123 - DNA, 29 bp, Artificial Sequence
  Description of Artificial Sequence: Synthetic primer 5'BSR198
cctccagcaacttcggcacccagacctac

SEQ ID NO: 1124 - DNA, 25 bp, Artificial Sequence
  Description of Artificial Sequence: Synthetic primer 3'BSR198
acctggttcttggtcatctcctccc

SEQ ID NO: 1125 - DNA, 31 bp, Artificial Sequence
  Description of Artificial Sequence: Synthetic primer 5'GME198
gttcaactggtacgtggacggcatggaggtg

SEQ ID NO: 1126 - DNA, 39 bp, Artificial Sequence
  Description of Artificial Sequence: Synthetic primer 3'TSS198
gtaggtctgggtgccgaagttgctggaggtcacggtcac

SEQ ID NO: 1127 - DNA, 20 bp, Artificial Sequence
  Description of Artificial Sequence: Synthetic primer Lambda844
aagcgtttcactaatgggcg

SEQ ID NO: 1128 - DNA, 22 bp, Artificial Sequence
  Description of Artificial Sequence: Synthetic primer F1042
ataagcggccgcgactctagag

SEQ ID NO: 1129 - DNA, 20 bp, Artificial Sequence
  Description of Artificial Sequence: Synthetic primer F1541
tcaccctccacctcttcacc

SEQ ID NO: 1130 - DNA, 19 bp, Artificial Sequence
  Description of Artificial Sequence: Synthetic primer F2058
ggactccaacgtcaaaggg

SEQ ID NO: 1131 - DNA, 19 bp, Artificial Sequence
  Description of Artificial Sequence: Synthetic primer F2538
aaacgcgcgagacgaaagg

SEQ ID NO: 1132 - DNA, 18 bp, Artificial Sequence
  Description of Artificial Sequence: Synthetic primer F3071
aaagcatcttacggatgg

SEQ ID NO: 1133 - DNA, 22 bp, Artificial Sequence
  Description of Artificial Sequence: Synthetic primer F3553
atgaacgaaatagacagatcgc

SEQ ID NO: 1134 - DNA, 18 bp, Artificial Sequence
  Description of Artificial Sequence: Synthetic primer F4068
ttaccggataaggcgcag

SEQ ID NO: 1135 - DNA, 18 bp, Artificial Sequence
  Description of Artificial Sequence: Synthetic primer F4557
atacgcaaaccgcctctc

SEQ ID NO: 1136 - DNA, 22 bp, Artificial Sequence
  Description of Artificial Sequence: Synthetic primer F5060
ttgcagctaatggaccttctag

SEQ ID NO: 1137 - DNA, 20 bp, Artificial Sequence
  Description of Artificial Sequence: Synthetic primer F5551
aatctggtggcaccttcgcg

SEQ ID NO: 1138 - DNA, 21 bp, Artificial Sequence
  Description of Artificial Sequence: Synthetic primer F6068
ttctcgagcttttggagtacg

SEQ ID NO: 1139 - DNA, 20 bp, Artificial Sequence
  Description of Artificial Sequence: Synthetic primer R1527
gggtgacagtggagcttcct

SEQ ID NO: 1140 - DNA, 18 bp, Artificial Sequence
  Description of Artificial Sequence: Synthetic primer R2023
actcttgttccaaactgg

SEQ ID NO: 1141 - DNA, 20 bp, Artificial Sequence
  Description of Artificial Sequence: Synthetic primer R2530
tctcgcgcgtttcggtgatg

SEQ ID NO: 1142 - DNA, 21 bp, Artificial Sequence
  Description of Artificial Sequence: Synthetic primer R3056
tgcttttctgtgactggtgag

SEQ ID NO: 1143 - DNA, 21 bp, Artificial Sequence
  Description of Artificial Sequence: Synthetic primer R3535
catccatagttgcctgactcc

SEQ ID NO: 1144 - DNA, 19 bp, Artificial Sequence
  Description of Artificial Sequence: Synthetic primer R4036
tccaacccggtaagacacg

SEQ ID NO: 1145 - DNA, 20 bp, Artificial Sequence
  Description of Artificial Sequence: Synthetic primer R4552
aggcggtttgcgtattgggc

SEQ ID NO: 1146 - DNA, 22 bp, Artificial Sequence
  Description of Artificial Sequence: Synthetic primer R5051
ccattagctgcaaagattcctc

SEQ ID NO: 1147 - DNA, 19 bp, Artificial Sequence
  Description of Artificial Sequence: Synthetic primer R5548
aaggtgccaccagattcgc

SEQ ID NO: 1148 - DNA, 20 bp, Artificial Sequence
  Description of Artificial Sequence: Synthetic primer R6051
gaactaatcgaggtgcctgg

SEQ ID NO: 1149 - DNA, 20 bp, Artificial Sequence
  Description of Artificial Sequence: Synthetic primer R6300
atggatctcgaggtcgaggg

SEQ ID NO: 1150 - DNA, 15 bp, Artificial Sequence
  Description of Artificial Sequence: Synthetic linker peptide
ggggsggggsggggs

SEQ ID NO: 1151 - DNA, 43 bp, Artificial Sequence
  Description of Artificial Sequence: Synthetic primer SCFCVH 5'
gactgcgtcgacgcgtacggaggtgcagctgttggagtctggg

SEQ ID NO: 1152 - DNA, 54 bp, Artificial Sequence
  Description of Artificial Sequence: Synthetic primer GSBAMVH 3'
tccacctccaccggatccaccacctccgctcgagacggtgaccagggttccctg

SEQ ID NO: 1153 - DNA, 78 bp, Artificial Sequence
  Description of Artificial Sequence: Synthetic primer FCBAMB 5'
ggaggtggtggatccggtggaggtggatctggtggtggtggatcacccaaatcttgtgacaaaactcacacatgccca

SEQ ID NO: 1154 - DNA, 20 bp, Artificial Sequence
  Description of Artificial Sequence: Synthetic primer 1926 3'
ggagacctgatactctcaag

SEQ ID NO: 1155 - DNA, 12 bp, Artificial Sequence
  Description of Artificial Sequence: Synthetic oligonucleotide CDR1-1 library
  modified_base (1)..(2): a, c, t or g
  modified_base (4)..(5): a, c, t or g
  modified_base (7)..(8): a, c, t or g
  modified_base (10)..(11): a, c, t or g
nnsnnsnnsnns

SEQ ID NO: 1156 - DNA, 12 bp, Artificial Sequence
  Description of Artificial Sequence: Synthetic oligonucleotide CDR1-2 library
  modified_base (1)..(2): a, c, t or g
  modified_base (4)..(5): a, c, t or g
  modified_base (7)..(8): a, c, t or g
  modified_base (10)..(11): a, c, t or g
nnsnnsnnsnns

SEQ ID NO: 1157 - protein, 7 aa, Artificial Sequence
  Description of Artificial Sequence: Synthetic peptide CDR2/3 library
SSSYRWP

SEQ ID NO: 1158 - DNA, 12 bp, Artificial Sequence
  Description of Artificial Sequence: Synthetic oligonucleotide CDR3 library
  modified_base (1)..(2): a, c, t or g
  modified_base (4)..(5): a, c, t or g
  modified_base (7)..(8): a, c, t or g
  modified_base (10)..(11): a, c, t or g
nnsnnsnnsnns

SEQ ID NO: 1159 - protein, 7 aa, Artificial Sequence
  Description of Artificial Sequence: Synthetic peptide
  MOD_RES (3)..(5): Any naturally occurring amino acid or absent
  MOD_RES (7)..(7): Any naturally occurring amino acid or absent
PIXXXLX

SEQ ID NO: 1160 - protein, 8 aa, Artificial Sequence
  Description of Artificial Sequence: Synthetic peptide
  MOD_RES (1)..(2): Any naturally occurring amino acid or absent
  MOD_RES (5)..(6): Any naturally occurring amino acid or absent
XXIHXXLR

SEQ ID NO: 1161 - protein, 5 aa, Artificial Sequence
  Description of Artificial Sequence: Synthetic peptide
  MOD_RES (1)..(1): Any naturally occurring amino acid or absent
  MOD_RES (5)..(5): Any naturally occurring amino acid or absent
XSSSX

SEQ ID NO: 1162 - protein, 6 aa, Artificial Sequence
  Description of Artificial Sequence: Synthetic peptide
  MOD_RES (1)..(1): Any naturally occurring amino acid or absent
  MOD_RES (6)..(6): Any naturally occurring amino acid or absent
XYRWPX

SEQ ID NO: 1163 - protein, 10 aa, Artificial Sequence
  Description of Artificial Sequence: Synthetic peptide
  MOD_RES (1)..(1): Any naturally occurring amino acid or absent
  MOD_RES (3)..(3): Any naturally occurring amino acid or absent
  MOD_RES (5)..(5): Any naturally occurring amino acid or absent
  MOD_RES (7)..(7): Any naturally occurring amino acid or absent
XCXQXYXWPV

SEQ ID NO: 1164 - protein, 5 aa, Artificial Sequence
  Description of Artificial Sequence: Synthetic peptide
WEGMM

SEQ ID NO: 1165 - protein, 5 aa, Artificial Sequence
  Description of Artificial Sequence: Synthetic peptide
MESMM

SEQ ID NO: 1166 - protein, 5 aa, Artificial Sequence
  Description of Artificial Sequence: Synthetic peptide
EEKWM

SEQ ID NO: 1167 - protein, 5 aa, Artificial Sequence
  Description of Artificial Sequence: Synthetic peptide
DEGMM

SEQ ID NO: 1168 - protein, 5 aa, Artificial Sequence
  Description of Artificial Sequence: Synthetic peptide
EYGLI

SEQ ID NO: 1169 - protein, 17 aa, Artificial Sequence
  Description of Artificial Sequence: Synthetic peptide
RCHEDGKNTYYADSVKG

SEQ ID NO: 1170 - protein, 17 aa, Artificial Sequence
  Description of Artificial Sequence: Synthetic peptide
RITWTGKNTYYADSVKG

SEQ ID NO: 1171 - protein, 17 aa, Artificial Sequence
  Description of Artificial Sequence: Synthetic peptide
RIGYMDKNTYYADSVKG

SEQ ID NO: 1172 - protein, 17 aa, Artificial Sequence
  Description of Artificial Sequence: Synthetic peptide
RITYSGKNTYYADSVKG

SEQ ID NO: 1173 - protein, 17 aa, Artificial Sequence
  Description of Artificial Sequence: Synthetic peptide
RCVWDGKNTYYADSVKG

SEQ ID NO: 1174 - protein, 17 aa, Artificial Sequence
  Description of Artificial Sequence: Synthetic peptide
RIGQDGKNTVIRDSVKG

SEQ ID NO: 1175 - protein, 17 aa, Artificial Sequence
  Description of Artificial Sequence: Synthetic peptide
RIGQDGKNTVLRDSVKG

SEQ ID NO: 1176 - protein, 17 aa, Artificial Sequence
  Description of Artificial Sequence: Synthetic peptide
RIGQDGKNTVDRDSVKG

SEQ ID NO: 1177 - protein, 17 aa, Artificial Sequence
  Description of Artificial Sequence: Synthetic peptide
RIGQDGKNTWTRDSVKG

SEQ ID NO: 1178 - protein, 17 aa, Artificial Sequence
  Description of Artificial Sequence: Synthetic peptide
RIGQDGKNTYYRGYMKG

SEQ ID NO: 1179 - protein, 17 aa, Artificial Sequence
  Description of Artificial Sequence: Synthetic peptide
RIGQDGKNTYYRVDVKG

SEQ ID NO: 1180 - protein, 17 aa, Artificial Sequence
  Description of Artificial Sequence: Synthetic peptide
RIGQDGKNTYYADRTDG

SEQ ID NO: 1181 - protein, 17 aa, Artificial Sequence
  Description of Artificial Sequence: Synthetic peptide
RIGQDGKNTYYRMDVKG

SEQ ID NO: 1182 - protein, 17 aa, Artificial Sequence
  Description of Artificial Sequence: Synthetic peptide
RIGQDGKNTYARMSVKG

SEQ ID NO: 1183 - protein, 17 aa, Artificial Sequence
  Description of Artificial Sequence: Synthetic peptide
RIGQDGKNTYYADRSFG

SEQ ID NO: 1184 - protein, 13 aa, Artificial Sequence
  Description of Artificial Sequence: Synthetic peptide
YTGRILGHHLFDY

SEQ ID NO: 1185 - protein, 13 aa, Artificial Sequence
  Description of Artificial Sequence: Synthetic peptide
YTGRILHHHLFDY

SEQ ID NO: 1186 - protein, 13 aa, Artificial Sequence
  Description of Artificial Sequence: Synthetic peptide
YDGWVGVHHLFDY

SEQ ID NO: 1187 - protein, 13 aa, Artificial Sequence
  Description of Artificial Sequence: Synthetic peptide
YTGRVFNHHLFDY

SEQ ID NO: 1188 - protein, 13 aa, Artificial Sequence
  Description of Artificial Sequence: Synthetic peptide
YTGRILAHHLFDY

SEQ ID NO: 1189 - protein, 13 aa, Artificial Sequence
  Description of Artificial Sequence: Synthetic peptide
YTGRVLNHHLFDY

SEQ ID NO: 1190 - protein, 13 aa, Artificial Sequence
  Description of Artificial Sequence: Synthetic peptide
YTGRVFKHHLFDY

SEQ ID NO: 1191 - protein, 13 aa, Artificial Sequence
  Description of Artificial Sequence: Synthetic peptide
YTGRVLGHHLFDY

SEQ ID NO: 1192 - protein, 5 aa, Artificial Sequence
  Description of Artificial Sequence: Synthetic peptide
EEGMM

SEQ ID NO: 1193 - protein, 13 aa, Artificial Sequence
  Description of Artificial Sequence: Synthetic peptide
YTGRILEHHLFDY

SEQ ID NO: 1194 - protein, 13 aa, Artificial Sequence
  Description of Artificial Sequence: Synthetic peptide
YTGRIFSHHLFDY

SEQ ID NO: 1195 - protein, 13 aa, Artificial Sequence
  Description of Artificial Sequence: Synthetic peptide
YTGRIFLHHLFDY

SEQ ID NO: 1196 - protein, 11 aa, Artificial Sequence
  Description of Artificial Sequence: Synthetic peptide
RASQPIVRNLR

SEQ ID NO: 1197 - protein, 7 aa, Artificial Sequence
  Description of Artificial Sequence: Synthetic peptide
SSSYLEP

SEQ ID NO: 1198 - protein, 11 aa, Artificial Sequence
  Description of Artificial Sequence: Synthetic peptide
RASQSNLRNLR

SEQ ID NO: 1199 - protein, 11 aa, Artificial Sequence
  Description of Artificial Sequence: Synthetic peptide
RASRTPVRNLR

SEQ ID NO: 1200 - protein, 11 aa, Artificial Sequence
  Description of Artificial Sequence: Synthetic peptide
RANRTRVRNLR

SEQ ID NO: 1201 - protein, 11 aa, Artificial Sequence
  Description of Artificial Sequence: Synthetic peptide
RKNNPFVRNLR

SEQ ID NO: 1202 - protein, 11 aa, Artificial Sequence
  Description of Artificial Sequence: Synthetic peptide
RKNHPNMRNLR

SEQ ID NO: 1203 - protein, 11 aa, Artificial Sequence
  Description of Artificial Sequence: Synthetic peptide
RKNHPHIRNLR

SEQ ID NO: 1204 - protein, 11 aa, Artificial Sequence
  Description of Artificial Sequence: Synthetic peptide
RKTHPTVRNLR

SEQ ID NO: 1205 - protein, 11 aa, Artificial Sequence
  Description of Artificial Sequence: Synthetic peptide
RKAHPMVRNLR

SEQ ID NO: 1206 - protein, 11 aa, Artificial Sequence
  Description of Artificial Sequence: Synthetic peptide
RKLQPFVRNLR

SEQ ID NO: 1207 - protein, 11 aa, Artificial Sequence
  Description of Artificial Sequence: Synthetic peptide
RKSSPMVRNLR

SEQ ID NO: 1208 - protein, 11 aa, Artificial Sequence
  Description of Artificial Sequence: Synthetic peptide
LKRHPSVRNLR

SEQ ID NO: 1209 - protein, 11 aa, Artificial Sequence
  Description of Artificial Sequence: Synthetic peptide
LKRQPSVRNLR

SEQ ID NO: 1210 - protein, 11 aa, Artificial Sequence
  Description of Artificial Sequence: Synthetic peptide
RKSHPFVRNLR

SEQ ID NO: 1211 - protein, 11 aa, Artificial Sequence
  Description of Artificial Sequence: Synthetic peptide
RASQTRVQNLR

SEQ ID NO: 1212 - protein, 11 aa, Artificial Sequence
  Description of Artificial Sequence: Synthetic peptide
RARRAPVRNLR

SEQ ID NO: 1213 - protein, 11 aa, Artificial Sequence
  Description of Artificial Sequence: Synthetic peptide
RARNTPVRNLR

SEQ ID NO: 1214 - protein, 11 aa, Artificial Sequence
  Description of Artificial Sequence: Synthetic peptide
RASRPNVRNLR

SEQ ID NO: 1215 - protein, 11 aa, Artificial Sequence
  Description of Artificial Sequence: Synthetic peptide
RASRPIVRNLR

SEQ ID NO: 1216 - protein, 11 aa, Artificial Sequence
  Description of Artificial Sequence: Synthetic peptide
RGSRPGIRNLR

SEQ ID NO: 1217 - protein, 11 aa, Artificial Sequence
  Description of Artificial Sequence: Synthetic peptide
RRSGPNVRNLR

SEQ ID NO: 1218 - protein, 11 aa, Artificial Sequence
  Description of Artificial Sequence: Synthetic peptide
LKSHPHVRNLR

SEQ ID NO: 1219 - protein, 7 aa, Artificial Sequence
  Description of Artificial Sequence: Synthetic peptide
SVSYLEP

SEQ ID NO: 1220 - protein, 7 aa, Artificial Sequence
  Description of Artificial Sequence: Synthetic peptide
SRSYLEP

SEQ ID NO: 1221 - protein, 7 aa, Artificial Sequence
  Description of Artificial Sequence: Synthetic peptide
SKSYLEP

SEQ ID NO: 1222 - protein, 7 aa, Artificial Sequence
  Description of Artificial Sequence: Synthetic peptide
SVSWLEP

SEQ ID NO: 1223 - protein, 7 aa, Artificial Sequence
  Description of Artificial Sequence: Synthetic peptide
SISYLEP

SEQ ID NO: 1224 - protein, 7 aa, Artificial Sequence
  Description of Artificial Sequence: Synthetic peptide
STKNVER

SEQ ID NO: 1225 - protein, 7 aa, Artificial Sequence
  Description of Artificial Sequence: Synthetic peptide
SWSFLQP

SEQ ID NO: 1226 - protein, 7 aa, Artificial Sequence
  Description of Artificial Sequence: Synthetic peptide
SSNYLAP

SEQ ID NO: 1227 - protein, 7 aa, Artificial Sequence
  Description of Artificial Sequence: Synthetic peptide
ARSYLEP

SEQ ID NO: 1228 - protein, 9 aa, Artificial Sequence
  Description of Artificial Sequence: Synthetic peptide
RMGYRWPVT

SEQ ID NO: 1229 - protein, 9 aa, Artificial Sequence
  Description of Artificial Sequence: Synthetic peptide
KAGYVWPVP

SEQ ID NO: 1230 - protein, 9 aa, Artificial Sequence
  Description of Artificial Sequence: Synthetic peptide
KAGYRWPVT

SEQ ID NO: 1231 - protein, 9 aa, Artificial Sequence
  Description of Artificial Sequence: Synthetic peptide
RSGYRWPVT

SEQ ID NO: 1232 - protein, 11 aa, Artificial Sequence
  Description of Artificial Sequence: Synthetic peptide
RASKPGVRNMR

SEQ ID NO: 1233 - protein, 11 aa, Artificial Sequence
  Description of Artificial Sequence: Synthetic peptide
RASKAGVRNLR

SEQ ID NO: 1234 - protein, 11 aa, Artificial Sequence
  Description of Artificial Sequence: Synthetic peptide
RASRPGVRNLR

SEQ ID NO: 1235 - protein, 11 aa, Artificial Sequence
  Description of Artificial Sequence: Synthetic peptide
QASQPGVRNMR

SEQ ID NO: 1236 - protein, 11 aa, Artificial Sequence
  Description of Artificial Sequence: Synthetic peptide
RILQPPGRNLR

SEQ ID NO: 1237 - protein, 11 aa, Artificial Sequence
  Description of Artificial Sequence: Synthetic peptide
RASHGGVRNLR

SEQ ID NO: 1238 - protein, 11 aa, Artificial Sequence
  Description of Artificial Sequence: Synthetic peptide
RASHSPVRNLR

SEQ ID NO: 1239 - protein, 11 aa, Artificial Sequence
  Description of Artificial Sequence: Synthetic peptide
RAGHPRVRNLR

SEQ ID NO: 1240 - protein, 11 aa, Artificial Sequence
  Description of Artificial Sequence: Synthetic peptide
RASNQRVRNLR

SEQ ID NO: 1241 - protein, 11 aa, Artificial Sequence
  Description of Artificial Sequence: Synthetic peptide
RKNHPDVRNLR

SEQ ID NO: 1242 - protein, 11 aa, Artificial Sequence
  Description of Artificial Sequence: Synthetic peptide
RKSQPNMRNLR

SEQ ID NO: 1243 - protein, 11 aa, Artificial Sequence
  Description of Artificial Sequence: Synthetic peptide
RASQPGVRNLR

SEQ ID NO: 1244 - protein, 11 aa, Artificial Sequence
  Description of Artificial Sequence: Synthetic peptide
RASQPSVRNLR

SEQ ID NO: 1245 - protein, 7 aa, Artificial Sequence
  Description of Artificial Sequence: Synthetic peptide
AKSYLEP

SEQ ID NO: 1246 - protein, 7 aa, Artificial Sequence
  Description of Artificial Sequence: Synthetic peptide
SSSYLNP

SEQ ID NO: 1247 - protein, 7 aa, Artificial Sequence
  Description of Artificial Sequence: Synthetic peptide
SRSFLEP

SEQ ID NO: 1248 - protein, 7 aa, Artificial Sequence
  Description of Artificial Sequence: Synthetic peptide
SVSFLEP

SEQ ID NO: 1249 - protein, 7 aa, Artificial Sequence
  Description of Artificial Sequence: Synthetic peptide
HVSDLEP

SEQ ID NO: 1250 - protein, 7 aa, Artificial Sequence
  Description of Artificial Sequence: Synthetic peptide
ASSNLEP

SEQ ID NO: 1251 - protein, 7 aa, Artificial Sequence
  Description of Artificial Sequence: Synthetic peptide
STSSLQP

SEQ ID NO: 1252 - protein, 7 aa, Artificial Sequence
  Description of Artificial Sequence: Synthetic peptide
SKSFLEP

SEQ ID NO: 1253 - protein, 7 aa, Artificial Sequence
  Description of Artificial Sequence: Synthetic peptide
SASYLEP

SEQ ID NO: 1254 - protein, 7 aa, Artificial Sequence
  Description of Artificial Sequence: Synthetic peptide
SSSYLQP

SEQ ID NO: 1255 - protein, 7 aa, Artificial Sequence
  Description of Artificial Sequence: Synthetic peptide
SSSLLEP

SEQ ID NO: 1256 - protein, 7 aa, Artificial Sequence
  Description of Artificial Sequence: Synthetic peptide
STSLLDR

SEQ ID NO: 1257 - protein, 9 aa, Artificial Sequence
  Description of Artificial Sequence: Synthetic peptide
LQGYRWPPT

SEQ ID NO: 1258 - protein, 9 aa, Artificial Sequence
  Description of Artificial Sequence: Synthetic peptide
RQGYRWPVT

SEQ ID NO: 1259 - protein, 9 aa, Artificial Sequence
  Description of Artificial Sequence: Synthetic peptide
KQGYRWPVQ

SEQ ID NO: 1260 - protein, 9 aa, Artificial Sequence
  Description of Artificial Sequence: Synthetic peptide
RQGYVWPVP

SEQ ID NO: 1261 - protein, 5 aa, Artificial Sequence
  Description of Artificial Sequence: Synthetic peptide
EESWM

SEQ ID NO: 1262 - protein, 5 aa, Artificial Sequence
  Description of Artificial Sequence: Synthetic peptide
EEKYM

SEQ ID NO: 1263 - protein, 5 aa, Artificial Sequence
  Description of Artificial Sequence: Synthetic peptide
EEYFM

SEQ ID NO: 1264 - protein, 17 aa, Artificial Sequence
  Description of Artificial Sequence: Synthetic peptide
RITDAGKNTYYADSVKG

SEQ ID NO: 1265 - protein, 17 aa, Artificial Sequence
  Description of Artificial Sequence: Synthetic peptide
RVTYDGKNTYYADSVKG

SEQ ID NO: 1266 - protein, 17 aa, Artificial Sequence
  Description of Artificial Sequence: Synthetic peptide
RIGQDGKNTYYREDVKG

SEQ ID NO: 1267 - protein, 17 aa, Artificial Sequence
  Description of Artificial Sequence: Synthetic peptide
RIGQDGKNTYYRSSVKG

SEQ ID NO: 1268 - protein, 17 aa, Artificial Sequence
  Description of Artificial Sequence: Synthetic peptide
RIGQDGKNTYYRSDVKG

SEQ ID NO: 1269 - protein, 17 aa, Artificial Sequence
  Description of Artificial Sequence: Synthetic peptide
RIGQDGKNTYTRDSVKG

SEQ ID NO: 1270 - protein, 17 aa, Artificial Sequence
  Description of Artificial Sequence: Synthetic peptide
RIGQDGKNTVYRDSVKG

SEQ ID NO: 1271 - protein, 17 aa, Artificial Sequence
  Description of Artificial Sequence: Synthetic peptide
RIGQDGKNTVVRDSVKG

SEQ ID NO: 1272 - protein, 17 aa, Artificial Sequence
  Description of Artificial Sequence: Synthetic peptide
RIGQDGKNTVLRDSVKG

SEQ ID NO: 1273 - protein, 17 aa, Artificial Sequence
  Description of Artificial Sequence: Synthetic peptide
RIGQDGKNTVIRDSVKG

SEQ ID NO: 1274 - protein, 16 aa, Artificial Sequence
  Description of Artificial Sequence: Synthetic peptide
RHGWDGKKYYADSVKG

SEQ ID NO: 1275 - protein, 13 aa, Artificial Sequence
  Description of Artificial Sequence: Synthetic peptide
YTGRIMGHHLFDY

SEQ ID NO: 1276 - protein, 13 aa, Artificial Sequence
  Description of Artificial Sequence: Synthetic peptide
YTGRVFEHHLFDY

SEQ ID NO: 1277 - protein, 13 aa, Artificial Sequence
  Description of Artificial Sequence: Synthetic peptide
YTGRILRHHLFDY

SEQ ID NO: 1278 - protein, 13 aa, Artificial Sequence
  Description of Artificial Sequence: Synthetic peptide
YTGRIYNHHLFDY

SEQ ID NO: 1279 - protein, 13 aa, Artificial Sequence
  Description of Artificial Sequence: Synthetic peptide
YTGRIFTHHLFDY

SEQ ID NO: 1280 - protein, 11 aa, Artificial Sequence
  Description of Artificial Sequence: Synthetic peptide
RFSYPIWTELN

SEQ ID NO: 1281 - protein, 11 aa, Artificial Sequence
  Description of Artificial Sequence: Synthetic peptide
RAVYLIWTELN

SEQ ID NO: 1282 - protein, 7 aa, Artificial Sequence
  Description of Artificial Sequence: Synthetic peptide
GSMHTQS

SEQ ID NO: 1283 - protein, 7 aa, Artificial Sequence
  Description of Artificial Sequence: Synthetic peptide
RSSSLQS

SEQ ID NO: 1284 - protein, 7 aa, Artificial Sequence
  Description of Artificial Sequence: Synthetic peptide
GSSSLQR

SEQ ID NO: 1285 - protein, 7 aa, Artificial Sequence
  Description of Artificial Sequence: Synthetic peptide
GHAELQS

SEQ ID NO: 1286 - protein, 10 aa, Artificial Sequence
  Description of Artificial Sequence: Synthetic peptide
QQFAYFPATF

SEQ ID NO: 1287 - protein, 10 aa, Artificial Sequence
  Description of Artificial Sequence: Synthetic peptide
EQFAYFPATF

SEQ ID NO: 1288 - protein, 10 aa, Artificial Sequence
  Description of Artificial Sequence: Synthetic peptide
KQFAYFSATF

SEQ ID NO: 1289 - protein, 10 aa, Artificial Sequence
  Description of Artificial Sequence: Synthetic peptide
KQFAYFPATF

SEQ ID NO: 1290 - protein, 6 aa, Artificial Sequence
  Description of Artificial Sequence: Synthetic peptide
GAYDMQ

SEQ ID NO: 1291 - protein, 16 aa, Artificial Sequence
  Description of Artificial Sequence: Synthetic peptide
SINKSGALTSYDSVKG

SEQ ID NO: 1292 - protein, 108 aa, Artificial Sequence
  Description of Artificial Sequence: Synthetic polypeptide
DIQMTQSPSSLSASVGDRVTITCRASQWIQKQLAWYQQKPGKAPKLLIYSSSYLQSGVPSRFSGSGSGTDFTLTISSLQPEDFATYYCQQHLRVPFTFGQGTKVEIKR

What is claimed:

1. An isolated, dual-specific antibody, or an antigen-binding portion thereof, with the following characteristics:
   a) dissociates from human IL-1α with a $K_D$ of $3 \times 10^{-7}$ M or less;
   b) dissociates from human IL-1β with a $K_D$ of $5 \times 10^{-5}$ M or less; and
   c) does not bind mouse IL-1α or mouse IL-1β,
   wherein the dual-specific antibody, or antigen-binding portion thereof, comprises
   a heavy chain variable region comprising all three complementary determining regions (CDRs) as set forth in the amino acid sequence selected from the group consisting of SEQ ID NO: 16; SEQ ID NO: 52; SEQ ID NO: 44; SEQ ID NO: 32; SEQ ID NO: 20; SEQ ID NO: 4; and
   a light chain variable region comprising all three CDRs as set forth in the amino acid sequence selected from the group consisting of SEQ ID NO: 36; SEQ ID NO: 24; SEQ ID NO: 28; SEQ ID NO: 40; SEQ ID NO: 12; SEQ ID NO: 48.

2. An isolated, dual-specific antibody, or an antigen-binding portion thereof, with the following characteristics:
   a) dissociates from human IL-1α with a $K_D$ of $3 \times 10^{-7}$ M or less;
   b) dissociates from human IL-1β with a $K_D$ of $5 \times 10^{-5}$ M or less; and
   c) does not bind mouse IL-1α or mouse IL-1β,
   wherein the dual-specific antibody, or antigen-binding portion thereof, comprises
   at least two heavy chain variable regions each comprising all three CDRs as set forth in the amino acid sequence selected from the group consisting of SEQ ID NO: 16; SEQ ID NO: 32; and SEQ ID NO: 4.

3. The antibody, or antigen-binding portion of claim 1 or 2, which neutralizes human IL-1α in a standard in vitro assay with an $ND_{50}$ of 900 nM or less.

4. The antibody, or antigen-binding portion of claim 1 or 2, which neutralizes human IL-1β in a standard in vitro assay with an $ND_{50}$ of 800 nM or less.

5. The antibody, or antigen-binding portion thereof, of claim 4, which neutralizes IL-1α in a standard in vitro assay with an $ND_{50}$ of 10 nM or less.

6. The antibody, or antigen-binding portion of claim 1 or 2, which neutralizes human IL-1α in a standard in vitro assay with an $ND_{50}$ of 900 nM or less, and neutralizes human IL-1β in a standard in vitro assay with an $ND_{50}$ of 800 nM or less.

7. The antibody, or antigen-binding portion of claim 1 or 2, which dissociates from IL-1α with a $K_D$ of $1 \times 10^{-8}$ M or less.

8. The antibody, or antigen-binding portion of claim 1 or 2, which dissociates from IL-1β with a $K_D$ of $5.4 \times 10^{-5}$ M or less.

9. The antibody, or antigen-binding portion, of claim 8, which dissociates from IL-1α with a $K_D$ of $1 \times 10^{-8}$ M or less.

10. The antibody, or antigen-binding portion, of claim 8, which dissociates from IL-1α with a $K_D$ of 40-86 nM or less.

11. The antibody, or antigen-binding portion, of claim 8, which dissociates from IL-1α with a $K_D$ of 20-42 nM or less.

12. The antibody, or antigen-binding portion, of claim 8, which dissociates from IL-1α with a $K_D$ of 32-42 nM or less.

13. The antibody, or antigen-binding portion, of claim 8, which dissociates from IL-1α with a $K_D$ of 7-12 nM or less.

14. The antibody, or antigen-binding portion, of claim 8, which dissociates from IL-1α with a $K_D$ of $3.0 \times 10^{-7}$ M or less.

15. The antibody, or antigen-binding portion, of claim 8, which dissociates from IL-1α with a $K_D$ of $1.1 \times 10^{-7}$ M or less.

16. The antibody, or antigen-binding portion, of claim 8, which dissociates from IL-1α with a $K_D$ of $6.1 \times 10^{-8}$ M or less.

17. The antibody, or antigen-binding portion, of claim 8, which dissociates from IL-1α with a $K_D$ of $6 \times 10^{-8}$ M or less.

18. The antibody, or antigen-binding portion, of claim 8, which dissociates from IL-1α with a $K_D$ of $4.2 \times 10^{-8}$ M or less.

19. The antibody, or antigen-binding portion, of claim 8, which dissociates from IL-1α with a $K_D$ of $1.3 \times 10^{-8}$ M or less.

20. The antibody, or antigen-binding portion, of claim 8, which dissociates from IL-1α with a $K_D$ of $1.1 \times 10^{-9}$ M or less.

21. The antibody, or antigen-binding portion, of claim 1 or 2, which neutralizes human IL-1β in a standard in vitro assay with an $ND_{50}$ of 200 nM or less.

22. The antibody, or antigen-binding portion of claim 1 or 2, which has an IgG1 heavy chain constant region.

23. The antibody, or antigen-binding portion of claim 1 or 2, which is a Fab.

24. The antibody, or antigen-binding portion of claim 1 or 2, wherein the antibody, or antigen-binding portion thereof, is human.

25. A pharmaceutical composition comprising the antibody, or antigen-binding portion thereof, of claim 1 or 2, and a pharmaceutically acceptable carrier.

26. The pharmaceutical composition of claim 25, which further comprises at least one additional therapeutic agent for treating a disorder in which IL-1α/IL-1β activity is detrimental.

27. The antibody, or antigen-binding portion of claim 1 or 2, which has an IgG4 heavy chain constant region.

28. The antibody, or antigen-binding portion of claim 1 or 2, which is a domain antibody (dAb).

29. The antibody, or antigen-binding portion of claim 1 or 2, which is a Fab'.

30. The antibody, or antigen-binding portion of claim 1 or 2, which is a $Fab_2$.

31. The antibody, or antigen-binding portion of claim 1 or 2, which is a Fab'$_2$.

32. The antibody, or antigen-binding portion of claim 1 or 2, which is an Fd.

33. The antibody, or antigen-binding portion of claim 1 or 2, which is a single chain Fv (scFv).

34. The antibody, or antigen-binding portion of claim 1 or 2, which is an scFv$_a$.

35. The antibody, or antigen-binding portion of claim 1 or 2, which dissociates from IL-1α with a $K_D$ of $1\times10^{-9}$ M or less.

36. The antibody, or antigen-binding portion of claim 1 or 2, which dissociates from IL-1α with a $K_D$ of 40-86 nM or less.

37. The antibody, or antigen-binding portion of claim 1 or 2, which dissociates from IL-1α with a $K_D$ of 20-42 nM or less.

38. The antibody, or antigen-binding portion of claim 1 or 2, which dissociates from IL-1α with a $K_D$ of 32-42 nM or less.

39. The antibody, or antigen-binding portion of claim 1 or 2, which dissociates from IL-1α with a $K_D$ of 7-12 nM or less.

40. The antibody, or antigen-binding portion of claim 1 or 2, which dissociates from IL-1α with a $K_D$ of $3.0\times10^{-7}$ M or less.

41. The antibody, or antigen-binding portion of claim 1 or 2, which dissociates from IL-1α with a $K_D$ of $1.1\times10^{-7}$ M or less.

42. The antibody, or antigen-binding portion of claim 1 or 2, which dissociates from IL-1α with a $K_D$ of $6.1\times10^{-8}$ M or less.

43. The antibody, or antigen-binding portion of claim 1 or 2, which dissociates from IL-1α with a $K_D$ of $6\times10^{-8}$ M or less.

44. The antibody, or antigen-binding portion of claim 1 or 2, which dissociates from IL-1α with a $K_D$ of $4.2\times10^{-8}$ M or less.

45. The antibody, or antigen-binding portion of claim 1 or 2, which dissociates from IL-1α with a $K_D$ of $1.3\times10^{-8}$ M or less.

46. The antibody, or antigen-binding portion of claim 1 or 2, which dissociates from IL-1α with a $K_D$ of $1.1\times10^{-9}$ M or less.

47. The antibody, or antigen-binding portion of claim 1 or 2, which dissociates from IL-1β with a $K_D$ of $2.8\times10^{-6}$ M or less.

48. The antibody, or antigen-binding portion of claim 1 or 2, which dissociates from IL-1β with a $K_D$ of $1.3\times10^{-6}$ M or less.

49. The antibody, or antigen-binding portion of claim 1 or 2, which dissociates from IL-1β with a $K_D$ of $9.3\times10^{-7}$ M or less.

50. The antibody, or antigen-binding portion of claim 1 or 2, which dissociates from IL-1β with a $K_D$ of $2\times10^{-7}$ M or less.

51. The antibody, or antigen-binding portion of claim 1 or 2, which dissociates from IL-1β with a $K_D$ of $1.1\times10^{-7}$ M or less.

52. The antibody, or antigen-binding portion of claim 1 or 2, which dissociates from IL-1β with a $K_D$ of $2.8\times10^{-8}$ M or less.

53. The antibody, or antigen-binding portion of claim 1 or 2, which dissociates from IL-1α with a $K_D$ of $1\times10^{-9}$ M or less.

54. An isolated antibody, or an antigen-binding portion thereof, having dual-specificity for human IL-1α and human IL-1β comprising a light chain variable region comprising all three complementary determining regions (CDRs) as set forth in the amino acid sequence selected from the group consisting of SEQ ID NO: 12, SEQ ID NO: 24, and SEQ ID NO: 28, and a heavy chain variable region comprising all three CDRs set forth in the amino acid sequence selected from the group consisting of SEQ ID NO: 4, SEQ ID NO: 8, SEQ ID NO: 16, and SEQ ID NO: 20.

55. The antibody, or antigen-binding portion thereof, of claim 54 which dissociates from human IL-1β with a $K_D$ of $5\times10^{-5}$ M or less.

56. The antibody, or antigen-binding portion thereof, of claim 54, which neutralizes human IL-1β in a standard in vitro assay with an $ND_{50}$ of 800 nM or less.

57. The antibody, or antigen-binding portion thereof, of claim 54, which neutralizes IL-1β in a standard in vitro assay with an $ND_{50}$ of 200 nM or less.

58. The antibody, or antigen-binding portion thereof, of claim 54, which dissociates from human IL-1β with a $K_D$ of $5\times10^{-5}$ M or less and neutralizes human IL-1β in a standard in vitro MRC5 assay with an $ND_{50}$ of 800 nM or less.

59. A pharmaceutical composition comprising the antibody, or antigen-binding portion thereof, of claim 54 and a pharmaceutically acceptable carrier.

60. The antibody, or antigen-binding portion thereof, of claim 54 which dissociates from human IL-1β with a $K_D$ of $5.4\times10^{-5}$ M or less.

61. The antibody, or antigen-binding portion thereof, of claim 54 which dissociates from human IL-1β with a $K_D$ of $2.8\times10^{-6}$ M or less.

62. The antibody, or antigen-binding portion thereof, of claim 54 which dissociates from human IL-1β with a $K_D$ of $1.3\times10^{-6}$ M or less.

63. The antibody, or antigen-binding portion thereof, of claim 54 which dissociates from human IL-1β with a $K_D$ of $9.3\times10^{-7}$ M or less.

64. The antibody, or antigen-binding portion thereof, of claim 54 which dissociates from human IL-1β with a $K_D$ of $2\times10^{-7}$ M or less.

65. The antibody, or antigen-binding portion thereof, of claim 54 which dissociates from human IL-1β with a $K_D$ of $1.1\times10^{-7}$ M or less.

66. The antibody, or antigen-binding portion thereof, of claim 54 which dissociates from human IL-1β with a $K_D$ of $2.8\times10^{-8}$ M or less.

67. An isolated antibody, or an antigen-binding portion thereof, having dual-specificity for human IL-1α and human IL-1β comprising a variable light chain comprising all three CDRs as set forth in the amino acid sequence selected from the group consisting of SEQ ID NO: 36, SEQ ID NO: 40, and SEQ ID NO: 48, and a variable heavy chain comprising all three CDRs set forth in the amino acid sequence selected from the group consisting of SEQ ID NO: 4, SEQ ID NO: 8, SEQ ID NO: 16, and SEQ ID NO: 20.

68. An isolated antibody, or an antigen-binding portion thereof, having dual-specificity for human IL-1α and human IL-1β comprising a variable light chain comprising all three CDRs as set forth in the amino acid sequence selected from the group consisting of SEQ ID NO: 36, SEQ ID NO: 40, and SEQ ID NO: 48, and a variable heavy chain comprising all three CDRs as set forth in the amino acid sequence selected from the group consisting of SEQ ID NO: 32, SEQ ID NO: 44, SEQ ID NO: 52.

69. A pharmaceutical composition comprising the antibody, or antigen-binding portion thereof, of claim 68 and a pharmaceutically acceptable carrier.

70. The antibody, or antigen-binding portion thereof, of claim 68, which dissociates from IL-1α with a $K_D$ selected from the group consisting of $3.0 \times 10^{-7}$ M or less; $1.1 \times 10^{-7}$ M or less; $6 \times 10^{-8}$ M or less; $4.2 \times 10^{-8}$ M or less; $1 \times 10^{-8}$ M or less; $1 \times 10^{-9}$ M or less.

71. The antibody, or antigen-binding portion thereof, of claim 68, wherein the isolated antibody, or antigen-binding portion thereof, dissociates from human IL-1α with a $K_D$ of $1 \times 10^{-7}$ M or less and neutralizes human IL-1α in a standard in vitro assay with an $ND_{50}$ of 900 nM or less.

72. An isolated antibody, or an antigen-binding portion thereof, having dual-specificity for human IL-1α and human IL-1β, said antibody, or antigen-binding portion thereof, comprising
  a variable light chain comprising all three CDRs as set forth in the amino acid sequence selected from the group consisting of SEQ ID NO: 12, SEQ ID NO: 24, and SEQ ID NO: 28, and a variable heavy chain comprising all three CDRs as set forth in the amino acid sequence selected from the group consisting of SEQ ID NO: 32, SEQ ID NO: 44, SEQ ID NO: 52.

73. An isolated antibody, or an antigen-binding portion thereof, having dual-specificity for human IL-1α and human IL-1β, said antibody, or antigen-binding portion thereof, comprising
  an IL-1α antigen binding region comprising a light chain variable region comprising a CDR1 domain, a CDR2 domain, and a CDR3 domain, wherein the amino acid sequence of the CDR3 domain is selected from the group consisting of SEQ ID NO: 11, SEQ ID NO: 23, and SEQ ID NO: 27, and
  an IL-1β antigen binding region comprising a heavy chain variable region comprising a CDR1 domain, a CDR2 domain, and a CDR3 domain, wherein the amino acid sequence of the CDR3 domain is selected from the group consisting of SEQ ID NO: 31, SEQ ID NO: 43, and SEQ ID NO: 51.

74. The antibody, or antigen-binding portion thereof, of claim 73, wherein the CDR2 domain of the light chain variable region of the IL-1α antigen binding region comprises the amino acid sequence selected from the group consisting of SEQ ID NO: 10, SEQ ID NO: 22, and SEQ ID NO: 26.

75. The antibody, or antigen-binding portion thereof, of claim 74, wherein the CDR1 domain of the light chain variable region of the IL-1α antigen binding region comprises the amino acid sequence selected from the group consisting of SEQ ID NO: 9, SEQ ID NO: 21, and SEQ ID NO: 25.

76. The antibody, or antigen-binding portion thereof, of claim 73, wherein the CDR2 domain of the heavy chain variable region of the IL-1β antigen binding region comprises the amino acid sequence selected from the group consisting of SEQ ID NO: 30, SEQ ID NO: 42, and SEQ ID NO: 50.

77. A pharmaceutical composition comprising the antibody, or antigen-binding portion thereof, of claim 73 and a pharmaceutically acceptable carrier.

78. The antibody, or antigen-binding portion thereof, of claim 76, wherein the CDR1 domain of the heavy chain variable region of the IL-1β antigen binding region comprises the amino acid sequence selected from the group consisting of SEQ ID NO: 29, SEQ ID NO: 41, and SEQ ID NO: 49.

79. A dual-specific, isolated antibody, or antigen-binding portion thereof, comprising an IL-1α antigen binding region and an IL-1β antigen binding region, wherein the antibody, or antigen-binding portion thereof, comprises
  a heavy chain variable region comprising all three CDRs as set forth in SEQ ID NO: 16 and a light chain variable region comprising all three CDRs as set forth in SEQ ID NO: 40.

80. A pharmaceutical composition comprising the antibody, or antigen-binding portion thereof, of claim 79 and a pharmaceutically acceptable carrier.

81. A dual-specific, isolated antibody, or antigen-binding portion thereof, comprising an IL-1α antigen binding region and an IL-1β antigen binding region, wherein the antibody, or antigen-binding portion thereof, comprises a light chain variable region comprising all three CDRs as set forth in SEQ ID NO: 24 and a heavy chain variable region comprising all three CDRs as set forth in SEQ ID NO: 52.

82. A dual-specific, isolated antibody, or antigen-binding portion thereof, comprising an IL-1α antigen binding region and an IL-1β antigen binding region, wherein the antibody, or antigen-binding portion thereof, comprises a light chain variable region comprising all three CDRs as set forth in SEQ ID NO: 28 and a heavy chain variable region comprising all three CDRs as set forth in SEQ ID NO: 52.

83. A dual-specific, isolated antibody, or antigen-binding portion thereof, comprising an IL-1α antigen binding region and an IL-1β antigen binding region, wherein the antibody, or antigen-binding portion thereof, comprises a light chain variable region comprising all three CDRs as set forth in SEQ ID NO: 28 and a heavy chain variable region comprising all three CDRs as set forth in SEQ ID NO: 44.

84. A dual-specific, isolated antibody, or antigen-binding portion thereof, comprising an IL-1α antigen binding region and an IL-1β antigen binding region, wherein the antibody, or antigen-binding portion thereof, comprises a heavy chain variable region comprising all three CDRs as set forth in SEQ ID NO: 16 and a light chain variable region comprising all three CDRs as set forth in SEQ ID NO: 36.

85. A dual-specific, isolated antibody, or antigen-binding portion thereof, comprising an IL-1α antigen binding region and an IL-1β antigen binding region, wherein the antibody, or antigen-binding portion thereof, comprises a light chain variable region comprising all three CDRs as set forth in SEQ ID NO: 12 and a heavy chain variable region comprising all three CDRs as set forth in SEQ ID NO: 32.

86. A dual-specific, isolated antibody, or antigen-binding portion thereof, comprising an IL-1α antigen binding region and an IL-1β antigen binding region, wherein the antibody, or antigen-binding portion thereof, comprises a light chain variable region comprising all three CDRs as set forth in SEQ ID NO: 24 and a heavy chain variable region comprising all three CDRs as set forth in SEQ ID NO: 44.

87. A dual-specific, isolated antibody, or antigen-binding portion thereof, comprising an IL-1α antigen binding region and an IL-1β antigen binding region, wherein the antibody, or antigen-binding portion thereof, comprises a heavy chain variable region comprising all three CDRs as set forth in SEQ ID NO: 20 and a light chain variable region comprising all three CDRs as set forth in SEQ ID NO: 48.

88. An isolated antibody, or an antigen-binding portion thereof, having dual-specificity for human IL-1α and human IL-1β, comprising
  an IL-1α antigen binding region comprising a heavy chain variable region comprising a CDR3 domain, a CDR2 domain, and a CDR1 domain, wherein the amino acid sequence of the CDR3 domain is selected from the group consisting of SEQ ID NO: 3, SEQ ID NO: 7, SEQ ID NO: 15, SEQ ID NO: 19, and
  an IL-1β antigen binding region comprising a light chain variable region comprising a CDR3 domain, a CDR2 domain, and a CDR1 domain, wherein the amino acid sequence of the a CDR3 domain is selected from the group consisting of SEQ ID NO: 35, SEQ ID NO: 39, and SEQ ID NO: 47.

89. The antibody, or antigen-binding portion thereof, of claim 88, wherein the CDR2 domain of the heavy chain variable region of the IL-1α antigen binding region comprises the amino acid sequence selected from the group consisting of SEQ ID NO: 2, SEQ ID NO: 6, SEQ ID NO: 14, and SEQ ID NO: 18.

90. The antibody, or antigen-binding portion thereof, of claim 89, wherein the CDR1 domain of the heavy chain variable region of the IL-1α antigen binding region comprises the amino acid sequence selected from the group consisting of SEQ ID NO: 1, SEQ ID NO: 5, SEQ ID NO: 13, and SEQ ID NO: 17.

91. The antibody, or antigen-binding portion thereof, of claim 88, wherein the CDR2 domain of the light chain variable region of the IL-1β antigen binding region comprises the amino acid sequence selected from the group consisting of SEQ ID NO: 34, SEQ ID NO: 38, and SEQ ID NO: 46.

92. The antibody, or antigen-binding portion thereof, of claim 91, wherein the CDR1 domain of the light chain variable region of the IL-1β antigen binding region comprises the amino acid sequence selected from the group consisting of SEQ ID NO: 33, SEQ ID NO: 37, and SEQ ID NO: 45.

* * * * *